United States Patent 7,879,556 (METHODS AND COMPOSITIONS FOR DIAGNOSING AND MONITORING TRANSPLANT REJECTION) - sequence listing, part 2

SEQ ID NO: 12281 - DNA, 548 bp, Homo sapiens
gcacgagataacttaagggatatctctgcaaggagaaacacctttttagatcttttagatgctgcttcttcaatgcaaggaaaggaaataaccccagcgaggtactcttcagggacacaggtctagtacaagagaactcttgacggctactaagttcagccagtcttaaaaaactgtgctgtttctacaaaactttaactacagtagtttataaggatgccaacgaaagctgagggtgtagagcaaaatagttctaagcttcagttaaacttctttaggtaagatcttatttacttttcctttcttaattttcctccctaaaagataaactaatactcttaaatggtctttcagtatagtggttcttacgtagtttaacatagctataaattgagtttaacaatttataaactcaagagaataatttttataaaccctgttttccaatctgtcatttacttaaattattttggttgtttttcccttttttttccttcttttcccaccccctccccctccatgtgaagatttgggtgcttaacatatca

SEQ ID NO: 12282 - DNA, 1296 bp, Homo sapiens
atccagcgccagctggagatcatgggcaaggaagtctcgggcgaccagatcgaggacatgttcgagcagggtaagtgggacgtgttttccgagaacttgctggccgacgtgaagggccgcgcgggccgccctcaacgagatcgagagccgccaccgcgaactgctgcgcctggagagccgcatccgcgacgtacacgagctcttcttgcagatggcggtgctggtggagaagcaggccgacaccctgaacgtcatcgagctcaacgtacaaaagacggtcgactacaccggccaggccaaggcgcaggtgcggaaggccgtgcagtacgaggagaagaacccctgccggaccctctgctgcttctgctgtccctgcctcaagtagcaggccggcccgggccgccaccgcccatcccagaccatggagcgcgctgggaaggacgtcaccaaagccgggagctctgccctgcagggagttgccccaaccctttccggaactcagtctttagaaaagaaacgccaggttcaagaattgcaaaccagcctgtgcttggaaagatggttagttgataccgtccgatgattcttcagtaaagatagattcccacaaagttgtgcaatgtcattatatgacaccttgcactcttaccgtcttgacagaagccaagtaaggaactgaagttgtatctgactgtagggtgaatgtctgaggcctgcctcctaataaagactcaaggaggaagtcaattgggcatctgctaatagaatgaactcatgatggaaacttcagttcatttactttgtccctgaaaattccctggttctgttccattttgagcgaaattggccttgggaaaaaccacgttcttcctttccgattcttcatccggtctacggctatgcaattcctccccaaatatagatcttatttctgctcatttcccctacttattaaaatcacaccaaacacttactattttcttatctctttcactttttaaatatctttcaccaggttatattttggtattatttttccaaacatttttaagcactgaatatcgaacaagcactcaaattgaagtatcagtcatgttttgtgtatttttcgctgataaaaattatttaacatttatatttttacttgattacatatgcacatgtatgtaaatgtaaaatactaatattcactaatatatgtacataatgatcaattggtttaacttcttttatgtaagtatggtatataaatttcaagacgaaaaaaaaaaaaaaaaaaaaaaaaaaaaaaaaaaa

SEQ ID NO: 12283 - DNA, 5537 bp, Homo sapiens
cggacgcgtggggttttattttacaggctgatgtaatctctaaactcaacatgacagacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaacacagctgaaggtttaacaagaaaaaatatgtcagatgtcagtgggtggcaaacatttttacaagcccttgactacttcctcaaaatgttctttggctctgcagcgctcggcactctcactggcttaatttctgcattagtgctgaagcatattgacttgaggaaaacgccttccttggagtttggcatgatgatcatttttgcttatctgccttatgggcttgcagaaggaatctcactctcaggcatcatggccatcctgttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcacaagtttgaaatttcctttgtcatctggtgcatagtgcttgtactatttggcagagcggtaaacattttccctctttcctacctcctgaatttcttccgggatcataaaatcacaccgaagatgatgttcatcatgtggtttagtggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatgggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggacctgcaccacgggcgcatccagatgaaaactctcaccaacaagtggtacgaggaggtacgccagggcccctccggctccgaggacgacgagcaggagctgctctgacgccaggtgccaaggcttcaggcaggcaggcccaggatgggcgtttgctgcgcacagacactcagcaggggcctcgcagagatgcgtgcatccagcagccccttcaagacataagagggcggggcgaggtactggctgcagagtcgccttagtccagaacctgacaggcctctggagccaggcgacttcttgggaaactgtcatctcccgactcctccctgagccagcctccgctcagtgtggctcctcagcccacagaggggagggagcatggggccaggtgccagtcatctgtgaagctagggcgcctacccccccacccggaggacccctgcggccccctgcctagaggagcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgaccttttgtcctttacctgattggcacttcgcagtctatctccctgggtagcagacggctgctgcccttctctgggcatgttctgaatgtttacactggtaccttctggtatcttctttagagccccctgcaagctgcaactctaggcttttatcttgcggggtcagagcgccctctagagggaaaagctagaggcacagggtttctgccggcccacaactgctgtcttgatttgcattttacagcaaagtgctgagagcctctagtcgcctcctgccatctgatctccctccccaccattcccgtactcagttgttcttttgtctaatcggaggccactgtgctgaggccctgcagtgtctgctcactgctgccatcttcgctgctagtcagggttccatcctctttcccctctcccagttccctaccacgttggatcccattcgtcacccatgctagggtccccaaagcactggggcaggggccagagcagcagcacccagtgctccctcctctactctgacctggggccccagcatcctggagcacacgctccacgcacacacaccccagccctgtcccaggggcctggccccctcagccatctcagggtgaggagctgccagtcatgtccagatggaatgactcccatcctctcctcatctcccctttgacgagcctcaaactgctcagctcatcaaagagccattgccaacttccgtatgtggttctgggtcccagggagccttggaacctggcaccctggggtggtttaattcatcattaagaagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttactttttgcatgaaaagtaaatgtgtacttgatagagctaaaatatgatcttttttaatttctcaaccccataatttgagccattgccttgcttaattttggtttccaccatttccttttagtggagaagagaggaagtcagagggtagggacctttgcctgcccctgggcgagtgcgggcagggatctgagaccagattgttctcgcacccctgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggtcacacctggcctcacactttgagctgagacttgaaaacgatgctgtggcggaagagcatgtggggcttggtggaggggccccaggatttgttgggggcaaagggggtggcgggaccgttcccaggaggtaccagcacctgcctcgatctcctctgagcctcttctgccccccgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactatatcttcctgcgtgtgtatttattttcttctgggtctaggccatggtacaggagaactgtggcgtgtaggaggaatacttcaggatgagtgaaggctggagccagggagcgctggaggaaaccagccctttagccagcagcccctccaccacaggcactgctgtgtggaacgagttcttggaatgaatcccatgctttctgcagcctgtagttgttatgacccctcggaacaaccaccccgtggcttgtgtggggtctcgcagggaaaagggctggcttctaggtccccgagataagtgtgcagggggatgggccagggccaggctaagggtggctcagttccatcatctggaggtcagacacactgtccagaggcagaactgaagccctctcggcccctaccctaagccagccacccctcttcacagtgggtgagctgggctgggctggctggcatgaggccaaggggtaggcctgagcgccagagtcgcccaggttagcccacaggattcctttgtgtgccatggaatgctgaaagatgggtgactggggacccttcttaaaacctttggcaaaggtgccatcggcagggcttggcctcatgaagtctcaggtccgtgttcccgcagggcgcacatgcttggagagtcctcagcagggtagccgaggccaggccacttctgctgaggatggggcaggctggggtgtgggtgtggcctggggtggctcagggctggaactgctgcctgattcctgtgtggggagaagctcagtggccgtttgctgccactgacaaggatttcacatgcagaagagaaaaggcccccctccaccccccgcattccctgccgagtgagagccagtgtttgctgcccttgctgggggcgggtaggaaaccctgagcttcctgatgcggagtcatgaagcagagtcctcgggaaggcatctccacagccccgggtcctctgtctaacgccctccatttcacgccctccatctcacagtcaagataaaggcctcgagaataaagagccagcccccttccatttagtctcctgccgtttcccaaacagttgtccaacagttagacattgaggggcttcactgttaccaggcatgtaacagaaggaggaagactaacacacaccccctgccccatcccatccccctctcccgagctattttcttgctgtggcctctggtgcccttgagttggtctccccggctgctctgcgggggcttcactggcttcggagtgagcgcgaagtgctggtgagcagtgggcctgtgattggatgggaagatgtgcatccgtggtcaaaagtcagctgccagccctgcggaaccagagcctcaggctgggatggggaggcctccctgcttccacctgcatggtgggcatggcctggcttacaccaaaggctttgacggtttctccaagtaaggatctgcaaatcttgaatcgtcctcaaaatgacgaagcttgaattgtcctcaagatggatgtgaatcttacattccttttcatcatttcctttgtaaaaatgacgagtgctgggtttttgttttaagaagcattatgaaggccagacttactcatttttctcccccaagtgagctgcaagaggcccctgttaggcccctgtttcctgagcagtgatgtgctgctcttcttggtggggctttgggctgggaggggaaggcgggtcagagatgggggacctgtggctgccatgcaggagcccctgcgtcatctcgttggactctttaagggagtcaggaatagatgtatgaacagtcgtgtcactggatgcctatttagaaataaagtgtatgctgctg

SEQ ID NO: 12284 - DNA, 487 bp, Homo sapiens
ttaagcattttctgcccacagaatgaaaacaacagcagagtcctgtgggcaagagggggaatcaggtgcccagaaagctgttttgtctccttccttccttatttaacacatgacctcaaggaagttaactaaactctctgggactctgagcctcttattgaagttaggaagagaaatattgttccttctcaacctcaagtcaccaaaggacaatgtggaggaacgtgccggttgcatgaggctcctgaaactcacaaacaccgtttccttcaaggaaaagaatggagccccttggggttttctgagtggctcacgtggccaggtataaggaagctacttttacctgcttggtgggaaacaaaaaattgattgtgtttcctcagatttttctcccagaacagaaactgttatctctttaaacataatacctttggtgcagacataaaatttatataatttccctgcatgggcaatgggaaaaatactt

SEQ ID NO: 12285 - DNA, 344 bp, Homo sapiens
ttttttttttttttttttgagacagagtctcactccgttgtccaggctggactagtgctaccatactgcatagtgcagttctagaataaagctaactaaagagaatcaataactaaatgcaatgtatgaaatttgattgcaaccttgatggaaaaaatagccataaatgataccttaagaacaaaaaggactaggaagtagacaatatagagaattgtttttaatttttttggtgtgataacttgtttcttatccttatttttgggatatactgaactagtaaagggtaaaatgtcatgttcagtgtgtggaaattgaaggagactaaggaaaacatgacaact

SEQ ID NO: 12286 - DNA, 470 bp, Homo sapiens
cttatcaaaatattttattttaggagacccctcaaaaaaagacccaccacattagacagacgccccaacaacacccttggcctttttttggtcttttctgtattttttcctttttaaatcaactaaaacaatttgatgcttaaaataaaagacaggaaatatttcctgatgagactttagtcgagaatatagatatatttctgatccgggggcgggtgatcaagggcgggggaggagaaggatgtgccaccagtggttcgcgaggttccgtttctcagctcaggagggagcctggctgcctggacccgggctagggacccagagctggggctccacaggcctgaccagggccagggaagaagaggttttgcatcctacctctgtccaacgcaaaacctcttctttcctggctaactcggtcctttgtggcagcctgactgaatccggggacaggacctaagacatgctga

SEQ ID NO: 12287 - DNA, 568 bp, Homo sapiens; identical to SEQ ID NO: 451

SEQ ID NO: 12288 - DNA, 5645 bp, Homo sapiens
cgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactg

SEQ ID NO: 12289 - DNA, 365 bp, Homo sapiens
  misc_feature 107, 137, 142, 217, 239, 247, 257, 263, 292, 344, 357: n = A,T,C or G
atcacaggataagcaatagattgtgtgggaaataataacacaagagtaaagatgctgaaggactcttctggaactcaaagtgacagttttgaaggttctggcacagnaggaaaggatcacaacccatataaatggcnaatgntgaatttctctgaacactgtcacatatggggcatcaatttggaaaactctcaattgaggccccttccctaagatnacaacattgataacctgtcttnttctctcncttctttacnatccgnccaagtctactattccaagtttaaatatngttcagaaagttgtcagccttgttagtcagaaaaactcccatttagagccanccaaactaggcanaagaaatt

SEQ ID NO: 12290 - DNA, 322 bp, Homo sapiens; identical to SEQ ID NO: 450

SEQ ID NO: 12291 - DNA, 20 bp, Artificial Sequence
  Synthesized Construct
cacaatgtggccgaggactt

SEQ ID NO: 12292 - DNA, 20 bp, Artificial Sequence
  Synthesized Construct
tgtggccgaggactttgatt

SEQ ID NO: 12293 - DNA, 20 bp, Artificial Sequence
  Synthesized Construct
tggcttttaggatggcaagg

SEQ ID NO: 12294 - DNA, 20 bp, Artificial Sequence
  Synthesized Construct
gggggcttagtttgcttcct

SEQ ID NO: 12295 - DNA, 20 bp, Artificial Sequence
  Synthesized Construct
aagtgcagcgttccttttgc

SEQ ID NO: 12296 - DNA, 20 bp, Artificial Sequence
  Synthesized Construct
agcgttccttttgcgagaga

SEQ ID NO: 12297 - DNA, 20 bp, Artificial Sequence
  Synthesized Construct
cgggctgttttccaaacatt

SEQ ID NO: 12298 - DNA, 20 bp, Artificial Sequence
  Synthesized Construct
gaagggacacgcaggtggta

SEQ ID NO: 12299 - DNA, 20 bp, Artificial Sequence
  Synthesized Construct
taccacctgcgtgtcccttc

SEQ ID NO: 12300 - DNA, 21 bp, Artificial Sequence
  Synthesized Construct
gaggcacttgttctgctgctg

SEQ ID NO: 12301 - DNA, 327 bp, Homo sapiens; identical to SEQ ID NO: 3096

SEQ ID NO: 12302 - DNA, 20 bp, Artificial Sequence
  Synthesized Construct
acgagcctgcaccaaagtct

SEQ ID NO: 12303 - DNA, 20 bp, Artificial Sequence
  Synthesized Construct
aaacaatggcatgcctccac

SEQ ID NO: 12304 - DNA, 20 bp, Artificial Sequence
  Synthesized Construct
tcattacagcgggggcttag

SEQ ID NO: 12305 - DNA, 20 bp, Artificial Sequence
  Synthesized Construct
gggggcttagtttgcttcct

SEQ ID NO: 12306 - DNA, 17 bp, Artificial Sequence
  Synthesized Construct
acgagcctgcaccaaag

SEQ ID NO: 12307 - DNA, 18 bp, Artificial Sequence
  Synthesized Construct
tcattacagcgggggctt

SEQ ID NO: 12308 - DNA, 584 bp, Homo sapiens; identical to SEQ ID NO: 427

SEQ ID NO: 12309 - DNA, 1202 bp, Homo sapiens
tgtccggcgccccccgggagggaactgggtggccgcaccctcccggctgcggtggctgtcgccccccaccctgcagccaggactcgatggagaatccattccaatatatggccatgtggctctttggagcaatgttccatcatgttccatgctgctgctgacgtcacatggagcacagaaatcaatgttagcagatagccagcccatacaagatcgtattgtattgtaggaggcatcgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttaaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgct

SEQ ID NO: 12310 - DNA, 1668 bp, Homo sapiens; identical to SEQ ID NO: 411

SEQ ID NO: 12311 - DNA, 734 bp, Homo sapiens
aatcaatcccacccttcattcaggaagtagccacctacctaacagaagaaacacctcaaccctattcataagccccagagcttaagtgacaacttaagacatattaaagaaactcaccaacagttcaatatgctgagtttcaaaatcaaactaggaaattctatgccccacccaaccaaatactcaggaaccttctcttcaccataaagctcaaatcccatttgagaacactgaccagaagtcaggaaatgcctgattgaattcacgaagccccacccacctggtaggaaggtcaatcttatgctcagaagtcccacccaccacccgagaagtcttcactttccctcccagggcccatcacacacagtccaatgcccactcagttaccctgacatccaacccactcaagaagttccacctagctctcggtaggtcccactcatttacatcttccaggaagtttccatccccgttcccatcactctcagccagctcaggaagtctaacacctttctagataccacaacaggcaattcagaaagtctatgcaccttcccaggaagccaccccactcctgtacaagtcacacctttgagccaattctgagactccactggtctgcttggttactatgatattcagctcaggaatttccccaaaagctctaccttcacagccaatgagaagtctctctcacttcaggagtatcatcatctaagtcctactccataaga

SEQ ID NO: 12312 - DNA, 1874 bp, Homo sapiens
gaattccggcaggcacaaactcatccatccccagttgattggaagaaacaacgatgactcctgggaagacctcattggtgtcactgctactgctgctgagcctggaggccatagtgaaggcaggaatcacaatcccacgaaatccaggatgcccaaattctgaggacaagaacttcccccggactgtgatggtcaacctgaacatccataaccggaataccaataccaatcccaaaaggtcctcagattactacaaccgatccacctcaccttggaatctccaccgcaatgaggaccctgagagatatccctctgtgatctgggaggcaaagtgccgccacttgggctgcatcaacgctgatgggaacgtggactaccacatgaactctgtccccatccagcaagagatcctggtcctgcgcagggagcctccacactgccccaactccttccggctggagaagatactggtgtccgtgggctgcacctgtgtcaccccgattgtccaccatgtggcctaagagctctggggagcccacactccccaaagcagttagactatggagagccgacccagcccctcaggaaccctcatccttcaaagacagcctcatttcggactaaactcattagagttcttaaggcagtttgtccaattaaagcttcagaggtaacacttggccaagatatgagatctgaattacctttccctctttccaagaaggaaggtttgactgagtaccaatttgcttcttgtttacttttttaagggctttaagttatttatgtatttaatatgccctgagataactttggggtataagattccattttaatgaattacctactttattttgtttgtctttttaaagaagataagattctgggcttgggaattttattatttaaaaggtaaaacctgtatttatttgagctatttaaggatctatttatgtttaagtatttagaaaaaggtgaaaaagcactattatcagttctgcctaggtaaatgtaagatagaattaaatggcagtgcaaaatttctgagtctttacaacatacggatatagtatttcctcctctttgtttttaaaagttataacatggctgaaaagaaagattaaacctactttcatatgtattaatttaaattttgcaatttgttgaggttttacaagagatacagcaagtctaactctctgttccattaaacccttataataaaatccttctgtaataataaagtttcaaaagaaaatgtttatttgttctcattaaatgtattttagcaaactcagctcttccctattgggaagagttatgcaaattctcctataagcaaaacaaagcatgtctttgagtaacaatgacctggaaatacccaaaattccaagttctcgatttcacatgccttcaagactgaacaccgactaaggttttcatactattagccaatgctgtagacagaagcattttgataggaatagagcaaataagataatggccctgaggaatggcatgtcattattaaagatcatatggggaaaatgaaaccctccccaaaatacaagaagttctgggaggagacattgtcttcagactacaatgtccagtttctcccctagactcaggcttcctttggagattaaggcccctcagagatcaacagaccaacatttttctcttcctcaagcaacactcctagggcctggcttctgtctgatcaaggcaccacacaacccagaaaggagctgatggggcagaatgaactttaagtatgagaaaagttcagcccaagtaaaataaaaactcaatcacattcaattccagagtagtttcaagtttcacatcgtaaccattttcgcccggaattc

SEQ ID NO: 12313 - DNA, 1816 bp, Homo sapiens
cttctctgccagaagataccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaacccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacattaaaa

SEQ ID NO: 12314 - DNA, 561 bp, Homo sapiens
accacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagact

SEQ ID NO: 12315 - DNA, 1103 bp, Homo sapiens; identical to SEQ ID NO: 452

SEQ ID NO: 12316 - DNA, 1231 bp, Homo sapiens
aggtctcagccggtcgtcgcgacgttcgcccgctcgctctgaggctcctgaagccgaaactagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctattttttttctctattctctccaatttgtttaaagaataaagtccaaagtctgatctggtctagttaacctagaagtatttttgtctcttagaaatacttgtgatttttataatacaaaagggtcttgactctaaatgcagttttaagaagtgtttttgaatttaaataaagttacttgaatttcaaac

SEQ ID NO: 12317 - DNA, 1702 bp, Homo sapiens; identical to SEQ ID NO: 429

SEQ ID NO: 12318 - DNA, 4156 bp, Homo sapiens; identical to SEQ ID NO: 453

SEQ ID NO: 12319 - DNA, 1451 bp, Homo sapiens; identical to SEQ ID NO: 2804

SEQ ID NO: 12320 - DNA, 5994 bp, Homo sapiens
gcgctgcccgcctcgtccccaccccccaaccccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctgtgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggcgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcccccacggccccccggacgacggcggcgcgggcgggaagggcggcagccgtgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgctaaaaaaaaaaaaaaaaaaaaaaaaaaaaaaaaaaaaaaaaaaaaaaaaaaaaaaaaaaaaaaaaaaaaaaaaaaaa

SEQ ID NO: 12321 - DNA, 1193 bp, Homo sapiens; identical to SEQ ID NO: 445

SEQ ID NO: 12322 - DNA, 1679 bp, Homo sapiens; identical to SEQ ID NO: 428

SEQ ID NO: 12323 - DNA, 825 bp, Homo sapiens
atcactctctttaatcactactcacattaacctcaactcctgccacaatgtacaggatgcaactcctgtcttgcattgcactaattcttgcacttgtcacaaacagtgcacctacttcaagttcgacaaagaaaacaaagaaaacacagctacaactggagcatttactgctggatttacagatgattttgaatggaattaataattacaagaatcccaaactcaccaggatgctcacatttaagttttacatgcccaagaaggccacagaactgaaacagcttcagtgtctagaagaagaactcaaacctctggaggaagtgctgaatttagctcaaagcaaaaactttcacttaagacccagggacttaatcagcaatatcaacgtaatagttctggaactaaagggatctgaaacaacattcatgtgtgaatatgcagatgagacagcaaccattgtagaatttctgaacagatggattaccttttgtcaaagcatcatctcaacactaacttgataattaagtgcttcccacttaaaacatatcaggccttctatttatttatttaaatatttaaattttatatttattgttgaatgtatggttgctacctattgtaactattattcttaatcttaaaactataaatatggatcttttatgattctttttgtaagccctaggggctctaaaatggtttaccttatttatcccaaaaatatttattattatgttgaatgttaaatatagtatctatgtagattggttagtaaaactatttaataaatttgataaatataaaaaaaaaaaacaaaaaaaaaaa

SEQ ID NO: 12324 - DNA, 2103 bp, Homo sapiens
ggcacgagggcatcccctgcgcgaagctgggtgccccggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtgtcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctcttccaatccaaaaatgttaaaattagccaggcatagttgtgtgtgcctacagtgctacaggaggctgaggcaagaggattgcttgagttaaggaaggaagtcaaggctgcagtgagctatggtcatgccactgcactccagcctgggcaacagcaagaccctgtgtcc

SEQ ID NO: 12325 - DNA, 961 bp, Homo sapiens; identical to SEQ ID NO: 12252

SEQ ID NO: 12326 - DNA, 4498 bp, Homo sapiens; identical to SEQ ID NO: 425

SEQ ID NO: 12327 - DNA, 6340 bp, Homo sapiens
gatctttgtagaatttgatggctgtaactggaagcaacactcctgggtaaaagttcatgctgaggaagttattgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcaagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgcgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccttcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggcggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtgggaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttactttttttttttttttaaataaaagtcatttaatgtagaatacttttaatttcactttctgtattttaattttgttgaagggctgattgggatttccatgttcttattaaaaatctaacaaatctgtaaaaaaaaaaaaaaa

SEQ ID NO: 12328 - DNA, 3389 bp, Homo sapiens
ggcacgaggggcgcggaggatgaggccgctgcctggcgctcttggcgtggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactgggttccaaatactataatccagatgtcatattcagtaaaatggaaaagtcagatgtgaaatttgaagatcgatttgacaatatcttgatcgtccttttttcacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatgggtgtgcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgactttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaaaaaaaaaaaaaaaaaaaaa

SEQ ID NO: 12329 - DNA, 3636 bp, Homo sapiens
aagggtgacggcgcgcgagcaagggggagggggtgttttggttctagccgctcgccgtccttgcaggctctgccgtcggaaagccgctcattctcgcttccccttccctttcccggctcaagtccttcctctctctttcctttctttccgcctatcttttttctgctgccgctccgggtccgggccattttccgggccgggcgcactaaggtgcgcggccccggggcccagtatatgacccgccgtcctgctatccttcgcttcccccgccccatgtggctgcggggccgcggcggcgctgcccactatggcccggaaagtagttagcaggaagcggaaagcgcccgcctcgccgggagctgggagcgacgctcagggcccgcagtttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttgaccaaaagtgatgcgagacacaatgtgtcacgggtccctgtgtatgcacacatcactcacaaggccttaaaggacatccccaaagaagacacaaaccctgacaactgcaaggttcgggctctggccttcaacaacaagaacaaggaactgggagcagtgtctctggatggctactttcatctctggaaggctgaaaatacactatctaagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagtctttctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccatggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttctggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagattttctgtttttaaaaatgtagcacttgactttttgccaaggaaaaaaataaaaattattccagtgc

SEQ ID NO: 12330 - DNA, 1402 bp, Homo sapiens
tctctccccaagaagagtcgagaaaatgttaaggaacttctctgctgttccatggaagaataccaacagtccccggtgaagctgcaggacttcttccagtatggtagttatgtctgtacggacgcttcggatctgggtctaccagagtgggtgctaggagctctggccaaagcgcgtaccacctttcatcagtgatgctttggtgctccgaaggacctttcttcacacacaggtagaaaacatgcagcggccaaatgctcacagaatatctcagcccatcaggcaaatcatctatgggcttcttttaaatgcctcaccacatctggacaagacatcctggaatgcattgcctcctcagcctctagctttcagtgaagtggaaaggattaataaaaatatcagaacctcaatcattgatgcagtagaactggccaaggatcattctgacttaagcagattgactgagctctccttgaggaggcggcagatgcttctgttagaaaccctgaaggtgaaacagaccattctggagccaatccctacttcactgaagttgcccattgctgtcagttgctactggttgcagcacaccgagaccaaagcaaagctacatcatctacaatccttactgctcacaatgctagtggggcccttgattgccataatcaacagccctggtaaggaagagctgcaggaagatggtgctaagatgttgtatgcagagttccaaagagtgaaggcgcagacacggctgggcacaagactggacttagacacagctcacatcttctgtcagtggcagtcctgtctccagatggggatgtatctcaaccagctgctgtccactcctctcccagagccagacctaactcgactgtacagtggaagcctggtgcacggactatgccagcaactgctagcatcgacctctgtagaaagtctcctgagcatatgtcctgaggctaagcaactttatgaatatctattcaatgccacaaggtcatatgcccccgctgaaatattcctaccaaaaggtagatcaaattcaaaaaaaaaaaggcagaagaaacagaataccagctgttctaagaacagagggagaaccactgcacacaccaagtgttggtatgagggaaacaaccggtttgggttgttaatggttgaaaacttagaggaacatagtgaggcctccaacattgaataaaactcagtttgcatcaaactagatgtatttaatataatccttacttaaaattcttccgttaccacccttgaaacaattagctttttctttaggactgacctgttaggggataaacatcacaataatctgaattccaagttattttgtattttgtttttaataaatacaacctgatttaagaaaaaaaaaaaaaaaaaa

SEQ ID NO: 12331 - DNA, 3700 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagacttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 12332 - DNA, 1567 bp, Homo sapiens
cccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaattaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgttaagaaaaaaaaaaaaaaa

SEQ ID NO: 12333 - DNA, 2182 bp, Homo sapiens
agttagtgcctggaccaggaccatcacactggggaccggcttctctgctctcccgttatgggggtcgggggaatgatgggtcaagggtcttccgaagaaagcgagaaaggaacaggcgccttcaaaagcccacttggcgatgggttacagtaagaggtacctccaggcccgggcatccgctggaaacaggggtgggtagggtcgtgtcatctaaaggcgcagcttcaaccagaagactagaagttagccaggagctgggagtagtgtcacgcggggtgggggttcctatgagcatcactttacaaaaccaggagggacggaagtgcgagggggcagagtcttggaaacaggtcctgggccaactgcaacagaatatacccgccgcgtgtaggggaaggcggcgccagggagagggcgcagtctctgaatctttccacggggtccatcctagggcccctccaggttcaacggtctcctaacctgtagtcacccacaagagcgtgccctttctgcccgcccttcctagcgttgctccctgcttggctgagcactgcggagtttcacgcctctaaaccccgcctcttcttgcaacctgtgttggcctcatctacccagcaactgtcgacgtcacacgacctgggcctccctgaatgggagatatttactaggcaatcccgcctactgttctgaggtttcccctccaggtgcagcttcagagccaggcgagccaggaaggaccagcgggcgaggtggtgagttgtgaggcgcgcccagtccctctgttcccgcctggcacttgctctggccgcacccgccccatctgccacttcggagaggccacggctctgagctgcggccgctagtgccctgatgggccctgtggctggggtcttgcacattcttgggggtgggcctaaggggataggggaagtggaaggggcctcataggaattaaaaagcttgagggaaaaggtgatgcagttagggggtaaaacattgaggatgataaaagaggagacacccgcagctgaaaagtgcgctgcaaaaggcagtgggccgtttggtgtgccggaaacataagaaaccacagtacaaaacaccaattttattataaatatcaagaacctacagggtgtttatgggccagcatatgccttcagttatgttgaaaatagctgatcatctttccgtacattctgaacatttctcagtttcagagtgctggccacaccaaagcatcagccctggctctaaactccgttacagtaaggaattacaaatcctgtgtctgtactccaggaagtctgcattatcacgaggagcttggaaaggaggtaacacactcaaggcaaatttcaagtaactcatcctggaggcagctgcatactctgcagctgtggttctccaccacagagagaagaaaagggagggagatggagtgcgcaggtctgagaaggctttcattctggagcatctgcaggagcctgcaccatggcccagtagcacccctttttctccatgagctgctggtgggttcccccctcccggatagcgcctccttccagaaagaggatgtggtcagcctgctccaccaggctgaggtgctgggtgatgagaagcactgagcgggagtaccgctcagggctttcgtacaggagctgctccacctgaggaaagacatcggaccgtcagagccggggactaccctcagcccagggagacacctgtgtttccagggctgggactgacctcacaggatcactgctggctctgctaacaaccccaaggacaccaacgtttcccattctgagtacttctccgcaaaccctttgtttcattaaggactgttttacatgaagggtgcaaaagtaggataaaaatgagaaccctagggtgaaacacgtgacagaagaataaagactattgaatagtcctcttctctacccatggacttggcatttttatattcgattttaaggaaatataacttagtagtaaagagatgagcattcaagtcaggcagacctgaatttgggtcaaggctgcgccactcaaaagctatatgacctctatatgagcagcttattcaacctcttttaacctccattttgtcatctgtagaatgatgataaatgcctagctcagaaggattcctaatgaataaatgagtgacagtgcatgt

SEQ ID NO: 12334 - DNA, 1237 bp, Homo sapiens
attcttgtctgttctgcctcactcccgagctctactgactcccaaaagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatgatgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggctttccctgtctattgccttttcctgtatctattttcctctatttcctatcattttattatcaccatgcaatgcctctggaataaaacatacaggagtctgtctctgctatggaatgccccatggggctctcttgtgtacttattgtttaaggtttcctcaaactgtgatttttctgaacacaataaactattttgatgatcttgggtggaaaa

SEQ ID NO: 12335 - DNA, 1030 bp, Homo sapiens; identical to SEQ ID NO: 2816

SEQ ID NO: 12336 - DNA, 2025 bp, Homo sapiens; identical to SEQ ID NO: 414

SEQ ID NO: 12337 - DNA, 1975 bp, Homo sapiens
actttcccccctcggcgccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccctggccgggacttgtggggtccttctcctgtcactggttatcaccctttactgcaaccacaggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattttcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatcatgctgagagagctggaggcacccatgccatctcaacctcttccccgcccgttttacaaagggggaggctaaagcccagagacagcttgatcaaaggcacacagcaagtcagggttggagcagtagctggagggaccttgtctcccagctcagggctctttcctccacaccattcaggtctttctttccgaggcccctgtctcagggtgaggtgcttgagtctccaacggcaagggaacaagtacttcttgatacctgggatactgtgcccagagcctcgaggaggtaatgaattaaagaagagaactgcctttggcagagttctataatgtaaacaatatcagactttttttttttataatcaagcctaaaattgtatagacctaaaataaaatgaagtggtgagcttaaccctggaaaatgaatccctctatctctaaagaaaatctctgtgaaacccctacgtggaggcggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctccgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtaca

SEQ ID NO: 12338 - DNA, 1182 bp, Homo sapiens; identical to SEQ ID NO: 375

SEQ ID NO: 12339 - DNA, 1237 bp, Homo sapiens; identical to SEQ ID NO: 430

SEQ ID NO: 12340 - DNA, 1629 bp, Homo sapiens; identical to SEQ ID NO: 444

SEQ ID NO: 12341 - DNA, 3046 bp, Homo sapiens
ctgcagatagcactgggaaagacaccgcggaactccagcgagcggagacacgccaaggcccctccagggacctgtcttcctaactgccagggacgccgagccaactctgtgccttacattcgtatccgttttcctatctctttcccgtggtccagcccagccttctccactgtttttttccctcttgcacagagttagaatcttaagtcagtgtcacacaatgtgctgtgcatctggcacaacgataaacagcccgagggagggttggggacctaagtgtcctagagaattagaggagggaggcgaggctaagcgtctccgtcacgtggtgtcagacagaccaatcacgcgcattcttcggccacgacaagcgcgcctctgatcacgtgaccaggtccgctacccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggtacaaggcactatgaaatgatctagtttcgtgggtgaggggctgaagggcctatgatgcacggaggcggggaaaggatttagagataacgtggtttgaaaggcgggacctggtgcggggacgctcttgggaggagtcttctccccagccttagctggtttcatgatttctttgcgtctgtaggcaacgcggtaaaaatattgcttcggtgggtgacgcggtacagctgcccaagggcgttcgtaacgggaatgccgaagcgtgggaaaaagggagcggtggcggaagacggggatgagctcaggacaggtaagggaatgaaatcagcccttcttcctagaagctgcggcgggggtgtttgtcattcccttgatgtacggtaagtacgggccgactcatttttgcaggggtttgtgaagaagtcgcaggaaccgtaggctttcgttgggtctatagttaacgccggatcgcagttggaaaccaccagctttttgtcagtatatattactcattttatagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagatgtgagtggaatttgagggaaagagacattttttagtattgaatggtcttagggtttagtcaccccttttctccgtttagccttcaggctgttttatttttctcctgcccgtagttttctgtggggcttccccagtcttgccagttgtatttcctaaatgtctgttccttcacttccattgccattttcttttttagtgttctctcctcttcccagaatgttgcaaaaacctcttcactatacttcctccattttatcttcctgcattgcattccatatgaagcatgtcctccattccattaaccatagcttaaaaatcttagcttgctatccactgcctatagaaaaaacacatctccttggcatagcatgtaagactttcttacctctctatatttgttttcatttatctagcttagaattgtttgaatattgtgctgcttgactcgaactccttaggccaagagactgtttaacccgtgcgtatctatgacttagcatatagattattcaataaatgttctgctgaattgataatacgttttccacctttcttttcacttacagtgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggtgagaccctattgatgcctaatgcctgaactcttcaaaaccaattgctaattctctatctctgccccacctcttgattgctttcccttttcttatagttttttatgctaattctgtttcatttctataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcagccttgctgtcttcgtgtcttaccccttcgtggggctacacattctcttcctcatattttcatgcacacaagttgac

SEQ ID NO: 12342 - DNA, 2191 bp, Homo sapiens; identical to SEQ ID NO: 335

SEQ ID NO: 12343 - DNA, 618 bp, Homo sapiens
tgcatcgttagcttctcctgataaactaattgcctcacattgtcactgcaaatcgacacctattaatgggtctcacctcccaactgcttccccctctgttcttcctgctagcatgtgccggcaactttgtccacggacacaagtgcgatatcaccttacaggagatcatcaaaactttgaacagcctcacagagcagaagactctgtgcaccgagttgaccgtaacagacatctttgctgcctccaagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttgaattcctgtcctgtgaaggaagccaaccagagtacgttggaaaacttcttggaaaggctaaagacgatcatgagagagaaatattcaaagtgttcgagctgaatattttaatttatgagtttttgatagctttattttttaagtatttatatatttataactcatcataaaataaagtatatatagaatctaa

SEQ ID NO: 12344 - DNA, 2960 bp, Homo sapiens; identical to SEQ ID NO: 421

SEQ ID NO: 12345 - DNA, 1585 bp, Homo sapiens
cacaccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagtcccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggaggctgaacaataggctgttcccatgtagccccctggcctctgtgccttcttttgattatgttttttaaaatattatctgattaagttgtctaaacaatgctgatttggtgaccaactgtcactcattgctgaggcctctgctccccagggagttgtgtctgtaatcggcctactattcagtggcgagaaataaaggttgcttaggaaagaa

SEQ ID NO: 12346 - DNA, 1909 bp, Homo sapiens; identical to SEQ ID NO: 409

SEQ ID NO: 12347 - DNA, 1723 bp, Homo sapiens
gggggagtgcgaatttcttggcctgtcggcaggtgctttctcaaaggccccacagtcctccacttcctggggaggtagctgcagaataaaaccagcagagactccttttctcctaaccgtcccggccaccgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagtattcccctttatgtacaggatgctttggttatatttagctccaaaccttcacacacagactgttgtccctgcactctttaagggagtgtactcccagggcttacggccctgccttgggccctctggtttgccggtggtgcaggtagacctgtctcctggcggttcctcgttctccctgggaggcgggcgcactgcctctcacagctgagttgttgagtctgttttgtaaagtccccagagaaagcgcagatgctagcacatgccctaatgtctgtatcactctgtgtctgagtggcttcactcctgctgtaaatttggcttctgttgtcaccttcacctcctttcaaggtaactgtactgggccatgttgtgcctccctggtgagagggccgggcagaggggcagatggaaaggagcctaggccaggtgcaaccagggagctgcaggggcatgggaaggtgggcgggcaggggagggtcagccagggcctgcgagggcagcgggagcctccctgcctcaggcctctgtgccgcaccattgaactgtaccatgtgctacaggggccagaagatgaacagactgaccttgatgagctgtgcacaaagtggcataaaaaacagtgtggttacacagtgtgaataaagtgctgcggagcaagaggaggccgttgattcacttcacgctttcagcgaatgacaaaatcatctttgtgaaggcctcgcaggaagacgcaacacatgggacctataactgcccagcggacagtggcaggacaggaaaaacccgtcaatgtactagggtactgctgcgtcattacagggcacaggccatggatggaaaacgctctctgctctgctttttttctactgttttaatttatactggcatgctattgccttcctattttgcataataaatgcttcagtgaaaatgcagctttactctaa

SEQ ID NO: 12348 - DNA, 816 bp, Homo sapiens
atgcactttctttgccaaaggcaaacgcagaacgtttcagagccatgaggatgcttctgcatttgagtttgctagctcttggagctgcctacgtgtatgccatccccacagaaattcccacaagtgcattggtgaaagagaccttggcactgctttctactcatcgaactctgctgatagccaatgagactctgaggattcctgttcctgtacataaaaatcaccaactgtgcactgaagaaatctttcagggaataggcacactggagagtcaaactgtgcaagggggtactgtggaaagactattcaaaaacttgtccttaataaagaaatacattgacggccaaaaaaaaaagtgtggagaagaaagacggagagtaaaccaattcctagactacctgcaagagtttcttggtgtaatgaacaccgagtggataatagaaagttgagactaaactggtttgttgcagccaaagattttggaggagaaggacattttactgcagtgagaatgagggccaagaaagagtcaggccttaattttcaatataatttaacttcagagggaaagtaaatatttcaggcatactgacactttgccagaaagcataaaattcttaaaatatatttcagatatcagaatcattgaagtattttcctccaggcaaaattgatatacttttttcttatttaacttaacattctgtaaaatgtctgttaacttaatagtatttatgaaatggttaagaatttggtaaattagtatttatttaatgttatgttgtgttctaataaaacaaaaatagacaactgttc

SEQ ID NO: 12349 - DNA, 1589 bp, Homo sapiens
gaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctccaagaatctatctgcttatgcagtttttcagagtggaatgcttcctagaagttactgaatgcaccatggtcaaaacggattagggcatttgagaaatgcatattgtattactagaagatgaatacaaacaatggaaactgaatgctccagtcaacaaactatttcttatatatgtgaacatttatcaatcagtataattctgtactgatttttgtaagacaatccatgtaaggtatcagttgcaataatacttctcaaacctgtttaaatatttcaagacattaaatctatgaagtatataatggtttcaaagattcaaaattgacattgctttactgtcaaaataattttatggctcactatgaatctattatactgtattaagagtgaaaattgtcttcttctgtgctggagatgttttagagttaacaatgatatatggataatgccggtgagaataagagagtcataaaccttaagtaagcaacagcataacaaggtccaagatacctaaaagagatttcaagagatttaattaatcatgaatgtgtaacacagtgccttcaataaatggtatagcaaatgttttgacatgaaaaaaggacaatttcaaaaaaataaaat

SEQ ID NO: 12350 - DNA, 1793 bp, Homo sapiens; identical to SEQ ID NO: 334

SEQ ID NO: 12351 - DNA, 2615 bp, Homo sapiens; identical to SEQ ID NO: 462

SEQ ID NO: 12352 - DNA, 1172 bp, Homo sapiens; identical to SEQ ID NO: 441

SEQ ID NO: 12353 - DNA, 1158 bp, Homo sapiens; identical to SEQ ID NO: 2801

SEQ ID NO: 12354 - DNA, 5133 bp, Homo sapiens; identical to SEQ ID NO: 2799

SEQ ID NO: 12355 - DNA, 2298 bp, Homo sapiens; identical to SEQ ID NO: 434

SEQ ID NO: 12356 - DNA, 615 bp, Homo sapiens; identical to SEQ ID NO: 2834

SEQ ID NO: 12357 - DNA, 1873 bp, Homo sapiens
gacgatacgccgggcgcaggcgcagaagccgcgcccgtccgcggcgccgccagccagggcggaaacggctgcggcttcgctagggacgcatgcgcgggtcccttagttttcgcgagataacggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcacggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgcgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatatcacaaaaaaaaaaaaaaaaaaaaaaaaaaaaaaaaaaaaaaa

SEQ ID NO: 12358 - DNA, 1702 bp, Homo sapiens
ggagtcgaccgctcgggcagcgcaccgccacgagagcccgggacgcgggaaagaccgaaaggaagaggaagaggcaccggtggccatggggctggaggcggcgcgcgagctggagtgcgcggcgctgggcacgctgctgcgggatccgcgggaggcggaacgcacgctgctgctggactgccgccccttcctggccttctgccggcgccacgtgcgcgccgcgcggccagtgccttggaacgcgctgctgcggcgccgcgcgcgcggccctcctgccgccgttctcgcctgcctgctgcccgaccgcgcgctgcggacgcgcctggtccgcggggagctggcgcgggccgtggtgctggacgagggcagtgcctcggtggcggagctccggcccgacagcccggctcatgtgctgctggccgcgctgctgcacgagacccgcgcggggcccactgccgtgtacttcctgcgaggaggcttcgacggcttccagggctgctgtcccgatctgtgctctgaggcccccgcccctgcgctgccgccaacaggggacaaaaccagccgctccgactccagggctcctgtctacgaccagggtggccctgtggagatcttgccctacctgttcctgggcagctgcagtcactcgtcagacctgcaggggctgcaggcctgtggcatcacagccgtcctcaacgtgtccgccagctgccccaaccactttgagggccttttccgctacaagagtatccctgtggaggacaaccagatggtggagatcagtgcctggttccaggaggccataggcttcattgactgggtgaagaacagcggaggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagtttcatggggcagctgctgcagtttgagacccaggtgctgtgtcactgaggtggtgcccctctgcctgcctgccccactgtgctggcaggagctgactgtggactggtgggctcccctctgggccagcacagtcccctcacctccggcagggctgctacctcctcagagtttcagaagcccccacatgggggctctaggaatgccggcatgctggtctttccgacctggtgctcttctgctgggggactgaggctggccctcattcggggtcgggaaccaagggtgtgtctgctctttccctccccatcctctggcagaaatcagctagacgctataccgtggactctccctggtccaccaccatgttgaagcccttggcagcctgagagctccaaggaacaagctgtgacaaccaggagccctgtctgtgggttcgtctgcccagggcctggagcccaagccctgtgttcctggggaagctggggacttgggaagtgatgggtgtgtcatgttgcgtgtgtctgtctgtgagcctttcacacctgtgctggcgctggaaaattatttgtgctcagctgacatttaacacttcctcccccgcttcctcctagccctgtgggcaggggttggaaacttagcactttatatttatacagaacattcaggatttgtcaataaaatattgttatatttaaaaaaaaaaaaaaaaaaaaaaaaaaa

SEQ ID NO: 12359 - DNA, 1875 bp, Homo sapiens; identical to SEQ ID NO: 2836

SEQ ID NO: 12360 - DNA, 1411 bp, Homo sapiens
gcgactgtctccgccgagcccccggggccaggtgtcccgggcgcgccacgatgcggccgcggctgtggctcctcctggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacaattttacaaataagcagagaatacggttttggtgtcctgctacaaaaagacatcggtcagtaatgagcacgatgtggaaaaatgagagaagggacacattcaaccctggagagttcaatggctgctgaagctgcctgcttttcactgctgcaaggcctttctgtgtgtgatgtgcatgggagcaacttgttcgtgggtcatcgggaatactagggagaaggtttcattgcccccagggcacttcacagagtgtgctggaggactgagtaagaaatgctgcccatgccaccgcttccggctcctgtgctttccctgaactgggacctttagtggtggccatttagccaccatctttgcaggttgctttgccctggtagggcagtaacattgggtcctgggtctttcatggggtgatgctgggctggctccctcttggtcttcccaggctggggctgaccttcctcgcagagaggccaggtgcaggttgggaatgaggcttgctgagaggggctgtccagttcccagaaggcatatcagtctctgagggcttcctttggggccgggaacttgcgggtttgaggataggagttcacttcatcttctcagctcccatttctactcttaagtttctccccatttctactcttaagtttctcagctcccatttctactctcccatggcttcatgcttctttcatttttctgtttgttttatacaaatgtgttagttgtacaaataaa

SEQ ID NO: 12361 - DNA, 6383 bp, Homo sapiens; identical to SEQ ID NO: 2838

SEQ ID NO: 12362 - DNA, 2700 bp, Homo sapiens; identical to SEQ ID NO: 410

SEQ ID NO: 12363 - DNA, 1531 bp, Homo sapiens; identical to SEQ ID NO: 2839

SEQ ID NO: 12364 - DNA, 2154 bp, Homo sapiens; identical to SEQ ID NO: 420

SEQ ID NO: 12365 - DNA, 2733 bp, Homo sapiens
aagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaggagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaatactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaatgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaagcggggggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagccgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaaaaaaata

SEQ ID NO: 12366 - DNA, 1770 bp, Homo sapiens
gaggagtggattacatattccaacagttgttattacattggtaaggaaagaagaacttgggaagaaagagtttgctggcctgtgcttcgaagaactctgatctgctttctatagataatgaggaagaaatggtatgtgtggggacttcccagttggctgtaagttgccatttgaactaaacgaaatagatcaggaactgaggacatatctaaattttctagttttatagaaggcttttatccacaagaatcaagatcttccctctctgagcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtagcaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacatacatctgcatgcaaaggactgtgtaaagatgatcaaccatctcaataaaagccaggaacagagaagagattacaccagcggtaacactgccaaccgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaaggcaattcagatatccccaaggctgcctctcccaccacaagcccagagtggatgggctgggggaggggtgctgttttaatttctaaaggtaggaccaacacccaggggatcagtgaaggaagagaaggccagcagatcagtgagagtgcaaccccaccctccacaggaaattgcctcatgggcagggccacagcagagagacacagcatgggcagtgccttccctgcctgtgggggtcatgctgccacttttaatgggtcctccacccaacggggtcagggaggtggtgctgccccagtgggccatgattatcttaaaggcattattctccagccttaagatcttaggacgtttcctttgctatgatttgtacttgcttgagtcccatgactgtttctcttcctctctttcttccttttggaatagtaatatccatcctatgtttgtcccactattgtattttggaagcacataacttgtttggtttcacaggttcacagttaagaaggaattttgcctctgaataaatagaatcttgagtctcatgcaaaaaaaaaaaaaaaaaaaaaaaaa

SEQ ID NO: 12367 - DNA, 3293 bp, Homo sapiens
cgctccctcccctcctagctggcttcggcggggacggcggcggcggcggcggcggcggcggcgggcggggagggcgtgcgccggccgagaggtgtcggcggcgaggcaaaggaagtttcaagtggaaggtcgtccgtcggccggcgcgtcctcctgctctcctccgcagcatcatggcggagccgagcggctcgcccgtgcacgtccagcttccccagcaggcggccccggtgacagcggcggcggcggcggccccggcggccgcgacagcagcgccggccccggcagctcccgcggccccggccccggccccggccccggccccggcggcacaggctgtcggctggcccatctgcagggacgcgtacgagctgcaggaggttatcggcagtggagctactgctgtggttcaggcagccctatgcaaacccaggcaagaacgtgtagcaataaaacggatcaacttggaaaaatgccagaccagtatggatgaactattaaaagaaattcaagccatgagtcagtgcagccatcccaacgtagtgacctattacacctcttttgtggtcaaagatgaactttggctggtcatgaaattactaagtggaggttcaatgttggatatcataaaatacattgtcaaccgaggagaacacaagaatggagttctggaagaggcaataatagcaacaattcttaaagaggttttggaaggcttagactatctacacagaaacggtcagattcacagggatttgaaagctggtaatattcttctgggtgaggatggttcagtacaaatagcagattttggggtaagtgcgttcctagcaacagggggtgatgttacccgaaataaagtaagaaaaacattcgttggcaccccatgttggatggctcctgaagtcatggaacaggtgagaggctatgacttcaaggctgacatgtggagttttggaataactgccattgaattagcaacaggagcagcgccttatcacaaatatcctcccatgaaagtgttaatgttgactttgcaaaatgatccacccactttggaaacaggggtagaggataaagaaatgatgaaaaagtacggcaagtcctttagaaaattactttcactgtgtcttcagaaagatccttccaaaaggcccacagcagcagaacttttaaaatgcaaattcttccagaaagccaagaacagagagtacctgattgagaagctgcttacaagaacaccagacatagcccaaagagccaaaaaggtaagaagagttcctgggtcaagtggtcaccttcataaaaccgaagacggggactgggagtggagtgacgacgagatggatgagaagagcgaagaagggaaagcagctttttctcaggaaaagtcacgaagagtaaaagaagaaaatccagagattgcagtgagtgccagcaccatccccgaacaaatacagtccctctctgtgcacgactctcagggcccacccaatgctaatgaagactacagagaagcttcttcttgtgccgtgaacctcgttttgagattaagaaactccagaaaggaacttaatgacatacgatttgagtttactccaggaagagatacagcagatggtgtatctcaggagctcttctctgctggcttggtggatggtcacgatgtagttatagtggctgctaatttacagaagattgtagatgatcccaaagctttaaaaacattgacatttaagttggcttctggctgtgatgggtcggagattcctgatgaagtgaagctgattgggtttgctcagttgagtgtcagctgatgtatgtcccttgatgtcaccctgatctgtcatgccccaccgccacccctactcccttcaaccctccctctttctgcccatttcctcccaccccctcactcccatttcctagcaaaatcagaagattgtgaagaggccggcttcaacaaaatgggataaaaaaataattttttaaaacttacaacactccgagttctgctttattctctagcaatccacagtacaagaacaagcaaatgccacagctgcacgactgttgctcatttttccaaaagctatttaatattcttagcaatcaatttggatatcccttaagtgaaaagaatctgaaatacactcaggtggtcttatttattggcaacaaaaggaattttctatccagaagcctatttctcctttcattgttgttatttctgttataatactttaaattgtacatctgacaatactgcctcttttatgttgtatttagaaattaatatacttataaaattaagatttattagccaaacttgaattctagttttaaaactgactgtgaattttatttttcatatatttatgcattacacaccttagctataagaaaaaaagggttttgattatatgcttcttgcagttaatctcgttatttaaacaaaaagttttgggtctgtctttggagtatttgtaacttctaaattttgaaatgactgaattaggaatttggatgcttattcttttagtctgtttgcctaaaaaccaatttacaatctgactgtctcttgggagagggaggtgccttgcaaactttcacattaagaatgtgcctgaggctgctttactctggaatagtctcagatctaaaatttcctctatataaggtggcatatgttaagttttgcttcattggaccgtttagaatgctatgtaaaatgttgccattctgttagattgctaactatatacccatctctgatttggctctccttaagtgataggatttgttattctaaaggtgataaacttgaaaatatcagaatctgagttttacttgaaattttgcagaatacccaggtggagtgaaaattggaagggttttgtgcaatgactaaaaggtaaaacgctgttaaggttcaagaatcaatactttcaacccaagtagccccctgcttgactgtatattatggaactagtaaaccttaggattttgaaaattggagtctaatctttcaaggaggtgggctcccaggatggtaccattgctctttcctagctaaccctagatatggcagctctttaatgtacttcaaaaagcaaatatatattactaaggaaaaaaagttatttataattgccttgtcataattgttaaggtgttctagagccatttgcatacaatttaatgtaatttcattccattctattgtttacacaacgattactcgaagatgactgcaaaggtaaaaggaaaataaaagtgtattgcacaatgag

SEQ ID NO: 12368 - DNA, 850 bp, Homo sapiens; identical to SEQ ID NO: 2846

SEQ ID NO: 12369 - DNA, 2589 bp, Homo sapiens
cggcccgctggagaggaagcccgagagctgccgcgcgcctgccggacgagggcgtagaagccaggcgtcagagcccgggctccggtggggtcccccacccggccctcgggtcccccgccccctgctccctgcccatcccagcccacgcgaccctctcgcgcgcggaggggcgggtcctcgacggctacgggaaggtgccagcccgccccggatgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggcggatgttcccattcctgtcatttactgtggccgggctggagcccaccagccactacaggatgtttgtggacgtggtcttggtggaccagcaccactggcggtaccagagcggcaagtgggtgcagtgtggaaaggccgagggcagcatgccaggaaaccgcctgtacgtccacccggactcccccaacacaggagcgcactggatgcgccaggaagtttcatttgggaaactaaagctcacaaacaacaagggggcgtccaacaatgtgacccagatgattgtgctccagtccctccataagtaccagccccggctgcatatcgttgaggtgaacgacggagagccagaggcagcctgcaacgcttccaacacgcatatctttactttccaagaaacccagttcattgccgtgactgcctaccagaatgccgagattactcagctgaaaattgataataacccctttgccaaaggattccgggagaactttgagtccatgtacacatctgttgacaccagcatcccctccccgcctggacccaactgtcaattccttgggggagatcactactctcctctcctacccaaccagtatcctgttcccagccgcttctaccccgaccttcctggccaggcgaaggatgtggttccccaggcttactggctgggggccccccgggaccacagctatgaggctgagtttcgagcagtcagcatgaagcctgcattcttgccctctgcccctgggcccaccatgtcctactaccgaggccaggaggtcctggcacctggagctggctggcctgtggcaccccagtaccctcccaagatgggcccggccagctggttccgccctatgcggactctgcccatggaacccggccctggaggctcagagggacggggaccagaggaccagggtccccccttggtgtggactgagattgcccccatccggccggaatccagtgattcaggactgggcgaaggagactctaagaggaggcgcgtgtccccctatccttccagtggtgacagctcctcccctgctggggccccttctccttttgataaggaagctgaaggacagttttataactattttcccaactgagcagatgacatgatgaaaggaacagaaacagtgttattaggttggaggacaccgactaatttgggaaacggatgaaggactgagaaggcccccgctccctctggcccttctctgtttagtagttggttggggaagtggggctcaagaaggattttggggttcaccagatgcttcctggcccacgatgaaacctgagaggggtgtccccttgccccatcctctgccctaactacagtcgtttacctggtgctgcgtcttgcttttggtttccagctggagaaaagaagacaagaaagtcttgggcatgaaggagctttttgcatctagtgggtgggaggggtcaggtgtgggacatgggagcaggagactccactttcttcctttgtacagtaactttcaaccttttcgttggcatgtgtgttaatccctgatccaaaaagaacaaatacacgtatgttataaccatcagcccgccagggtcagggaaaggactcacctgactttggacagctggcctgggctccccctgctcaaacacagtggggatcagagaaaaggggctggaaaggggggaatggcccacatctcaagaagcaagatattgtttgtggtggttgtgtgtgggtgtgtgttttttctttttctttctttttattttttttgaatgggggaggctatttattgtactgagagtggtgtctggatatattccttttgtcttcatcactttctgaaaataaacataaaactgttaaaaaaaaaaaaaaaaa

SEQ ID NO: 12370 - DNA, 9408 bp, Homo sapiens
gttccactcacagatttcttcttattgcccaggcttgagtgcaatgacctgttctcagcttactcaacctctgcctcttgggtttcagtgatttttctgcctcggcctcctgagtagctaagggaggagtcttgagattatcatccacggagggtggaagaggagagggtggaaggggaataagaagacattcgggaggtgtcttgaggctcagggagttatcagttatagaatgttgttgagttggaggaagtggctggcggcccatcctgttttttaaagtttcacctgtgaagtagggccagtagggcaatcctgaagaatgacgatgctccgctgccgccattctgacctgtaaggccgaaagaaagggaatgttttcacacatattcatttgatggacaaaattaccgccaccaacacggtctgcaccttctgttgctggtgataaatttttgcacctttccatcctccaggtttcaaaatagcagtatcagtgtcataatatcacccttccactgagtactgccgacagctggggagtaaaaaaaagtcattgggacatcaccctacagcagttcaggctgtgtggttcgcaagaagcatacactggctttttgattcttgctagttcccagctcacagtttgggaggatccaacaccaacctttacgtgaagtggaggcccaaggacagtgaggagctgggtggtcccagcctggagctgtgccagcctgacatggaaatggaggcaaacgaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaaaagttctgggccaacggtacccatagtcccatggggcttaactttgattcacaagaactgtatgattcctttcctgaccagaattttgaggaggtatgcagtggtatccatcctgatgaggcagcagaaaaagagatgacttccgttgtggcagaaaatggcactggcttggtatgcagcttggagctggaagaagaacagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaagacaagctgcctcttgaggacagccctgtgatttctgcccttgattgcccttccctcaataatgctactgccttcagtctcctggcagatgatagtcaaacatcaacttctatctttgccagtcccacttctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcttcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacctggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtctgactactatccaagggcaggccagaaataagcggaaacaagagaccaagagcttaaagcacaaggaagctaagaagaaatccaaggctgagaaagaaaaaggaaagacaaagcaggaaaaactgaaggaaaaagtcaagagggaaaagaaggagaaggttaaaatgaaggaaaaggaggaggtgaccaaagccaagccagcctgtaaagcagataagaccctggccacacagaggcgcttggaggaacggcagaagcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgaaatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccctgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatgggaaggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaagccgacctctaaaaactaagcccgggtttatgcaacctaggcattttaagtcccctgtcaggggtcaggattcagaacagccccaggcccagcttcagcctgaggctcagcttcatgttcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcttcaagcattctggtttaacatctcagcccagatgccctgcaatgctgcccccacaccgccccttgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggataccagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtccgggcagggagggactggcacctcaacgtaaaactaccaaccctttggacctggctgtgatgcggctggctgccctggaacaaaatgtaaaacggcggtacctgcgggagcccctctggccaactcatgaggttgtgctggagaaagccctgcttagcacacctaatggtgcccctgagggcaccactacagagatatcatatgagatcacccctcgcattcgtatctggcgccagaccctccagcggtgccggagcgcagcccatgtgtgcttgtgcctgggccatctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagaaggtgatggccgccgacgccgggtactgttgaagggccgagaaagcccagcagcagggcctcggtactcggaagaaaggctctccccctccaagcggcggcgactctctatgcggaaccaccacagtgatctcacattttgcgagattatcctgatggagatggaatcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagaggagtccttctggactaaaagccaaaaaaagaaagaaaaaaataatttttcttttctgttttatttgctaattaaaaatggggagggggaaagtcgtccctacttcctcctccgtgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcggccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcattagctggggagagggcagggaggcttcctgggccttccaacctccttccccacctccttcccaaaccctcttgggaactcctcagggacaactactgctgagtttgggtgcacccaaagatggaggccaagtagcaatggggccggcctcacagagagcgccgtgtgtgtgtgtgtgtgtgtgtgtgtgtgtgtgtccgccacacaacgcgctgtgtgtgtgtgtgtgtgtctcacacacacagcgcgcagtgtgtgtgtgtgtgtgtgtgtgtatgtgtgtgtgtgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcatcttttcagcaggaactccctctcttctcggtagctttgaatcttaagcttctacgggagagtggtagaactggatcatttcataatcccatttagttgtgcttttcttcatatacttcataccccaggaccccttccccagcagcagagaccctggagcacaggagagtagggaggaggggttctgggtccatcactgccttacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccttggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatttcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagagattcaaaagactctgtgtattcatcttcccttctacacacctgagggggagacggcgttgggataggtatgactggcttaagagaccacaggcaagggaacaacaggggctcctgttccataccctctgtgtgggatggaaagggtcattagtgctcccgcctaaatgtctggctgagttgctggaagcaaaggggggattcagtgcatccaggtcctgccttgtgagatgtggccccagcttcctaagctgccacctctgtgttcctgtcatagcaaatatgggaccatcaccagcttaccacttcccactcacggataagacaccaagacgtagac

SEQ ID NO: 12371 - DNA, 1242 bp, Homo sapiens; identical to SEQ ID NO: 433

SEQ ID NO: 12372 - DNA, 3426 bp, Homo sapiens; identical to SEQ ID NO: 438

SEQ ID NO: 12373 - DNA, 7603 bp, Homo sapiens; identical to SEQ ID NO: 2852

SEQ ID NO: 12374 - DNA, 4516 bp, Homo sapiens
ctcggcgcgcctggacccctgcccctctctgggtggagaagctcccggccgcttcccggtttcactccttctcagcctgggctcccagcccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcagggcatgaccattcggcccctggtagacctgttggctgtgaagaaaaagcaagagacgaagcgctccatcaacgaagagatccacacacagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaggagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcagtgacccaggcccacaccctgagcctggggagggagaaccgttcttccccaaggggcagtaacgccagggccagcaggcagcgcctgtcccctcacagactcttccaccagagcaggggctgctgggggctccccttgcccttcctgacccggattggccctgcccctccccctaccgcatggcagctgggcccacagcccccaccccagcacagctcctcccctgccgcctcccgggaagcatcctccccaccagagctgcctccccaatccatttggcagaactgctggggctggtgaggccggccctgcccctccctagatccaggcttctcccggacctggactagggcctcggaggctcctccctctgcctcatcctcctcctcattcagaccaatcttagtttctaaccaaagagtctctggctcagctgtggtcccacccaggaagggagggagctgaggcctcccttgagtaggccctgctttatcaggggacaaaccaggggtaccaggcacatggctgggggagggactgctgacccaccaaggtctcacactcctcctgccagctctgtcaccctggccaccacccaacctatccttactcagagctgcgggctgagggcatctctgagtgtctctgcctggagcaggggtggtttctacggtgacagtgacgtgactcagagcttttcgaactgtgctcccacggggaccactgggcccctcaggggaagctgctaggggaaggactggccgtggctccagaatgtgctgcctttttaagttttgtttgttcacactcctatatatgattgtttgcacagagggcgctcctgtttttaaaacattttgaaaacccctggctgaacagtgctctgcctctaactccctcctcacactccagaattacccttcctcatctgtgcctgtctgtccaacccctcccccacgtctctctgcctgctgggctcttaactgttgctcgaagactgtgacatcagaagtaactcccactcctaatcaagagtctctccagcctcacagatgctggcctcttggcacctgcctagctcttgggcctgacctccagtcctgctggcctgctcttacttcccccaccctgggtttggcccctggaacctttcccttgtgtgtaccacaccctgcctgctgtggagcccattgtggaggcggtgggggggagaaggcctcccctgaggatcccctgtcccctggggctggtggattgggcagaatcctgggcccccagagacctttgcccacacacactccttccccttgtccctggggcactcccccaggattgtgcaatagtcagagtgtccctttttgcaggggactgggccatgggtcctcggcccatctgtccatcctcctctccatgcaagtgctgtttgggcaggagtcaccatgcaagggtgacatcgacaaccacgtaccaagccaccgcagctgctgccactctgctgcctgtacagaagaaactgaatctttttcatattctaataaatcaatgtgagtttt

SEQ ID NO: 12375 - DNA, 4465 bp, Homo sapiens; identical to SEQ ID NO: 460

SEQ ID NO: 12376 - DNA, 1764 bp, Homo sapiens; identical to SEQ ID NO: 419

SEQ ID NO: 12377 - DNA, 1125 bp, Homo sapiens; identical to SEQ ID NO: 431

SEQ ID NO: 12378 - DNA, 1915 bp, Homo sapiens
agcgatttcatcttcaggcctggactacaccactcaccctcccagtgtgcttgagaaacaaactgcacccactgaactccgcagctagcatccaaatcagcccttgagatttgaggccttggagactcagatcctgaacaagagagaacaaaatctctactttgatggaacttccattctgtggggaagagactgacaataagcaattaaataaataagaactcagcagtaggccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcaacaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagctt

SEQ ID NO: 12379 - DNA, 696 bp, Homo sapiens; identical to SEQ ID NO: 436

SEQ ID NO: 12380 - DNA, 384 bp, Homo sapiens; identical to SEQ ID NO: 439
  misc_feature 144, 145, 159, 165, 223, 309: n = A,T,C or G

SEQ ID NO: 12381 - DNA, 961 bp, Homo sapiens
  misc_feature 601: n = A,T,C or G
ttttttttttttaatctactagggtctttatttggaagttacatatgatttaaagagccatgtatagatgtcaagatcacaatggggtgaactatggtggtttcatcctgtgtcaatgcagctaagctaaaactatttcccaggttctctgtctgacctggttctgggtaatggcttgatcacagacaaatctacacaggatttagaaggtagaagtttagtaacagtcattatgctaaacaggctaacatggggcccgtgcccttggctttctcaggttgctgtgaatctgccaacttgttgggttaagtgggacagtgagcagcccacgctcctgcctctgctcttccaacttccaggccaggaatgtgtgcaactctctggaaaaagtggccaagcggttttcttctgcagggcacctgtcagtgtgggatgaggtcagatagatgtgcactctagcctgtttttgctcgtttctacttctcatcctaccgtgactttaggcagagatccagctttccactgacttatccaccaccttggtggaacctggttagagatttttctcagacctctaacttgctaccttcttgtagaattntacttggtttcttccacattgcttttgcttctcctatccaaccttttatggatacaatagcaaacagttttccagtggttccaacattcattatccagcagtggattggagttcccattatgcaatatccctgacaacatttgagtcttgcagatttctctagtttttgccaaatctggtggcggtaatagtaacctaactgggtactattcttcaggttcctgattaccataaagatgcacagttggttctaagtggcccatggcatttctttcttaagtttatttaaatttctgaaaatgaccttccgattctttaatggaggttagtttctggggtgtcctttgagacccataactg

SEQ ID NO: 12382 - DNA, 691 bp, Homo sapiens; identical to SEQ ID NO: 423
  misc_feature 35, 140, 394, 397, 401, 404, 412, 536, 569, 581, 615, 619,640, 651, 662, 677, 680, 687: n = A,T,C or G

SEQ ID NO: 12383 - DNA, 1705 bp, Homo sapiens; identical to SEQ ID NO: 424

SEQ ID NO: 12384 - DNA, 292 bp, Homo sapiens; identical to SEQ ID NO: 417

SEQ ID NO: 12385 - DNA, 1046 bp, Homo sapiens; identical to SEQ ID NO: 458

SEQ ID NO: 12386 - DNA, 2075 bp, Homo sapiens; identical to SEQ ID NO: 454

SEQ ID NO: 12387 - DNA, 2602 bp, Homo sapiens
gccgtgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcggcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 12388 - DNA, 3084 bp, Homo sapiens; identical to SEQ ID NO: 448

SEQ ID NO: 12389 - DNA, 1670 bp, Homo sapiens; identical to SEQ ID NO: 449

SEQ ID NO: 12390 - DNA, 4381 bp, Homo sapiens
gccttcaactaccatcccaccacctgctgaggagaaaaattcttcaagactcagagcacacagccagcaccagaggccccatgaccctggacagaccaggggagggggccaccatgctgaagacattcactgttttgctcttttgcattcggatgagtctgggtatgacatcgatagtgatggaccctcaaccggagttgtggatagagtccaactacccccaggccccttgggagaacatcacgctttggtgccgaagcccctctcggatatcaagcaagttcctgctgctgaaggataagacacaaatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtaactgacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtagataagccccccaaaccctccctgtcagcttggccaagcactgtgttcaagctaggaaaggccatcacccttcagtgccgagtatctcatccagtactggaattttctctggaatgggaagaaagagaaacattccaaagattctcagtaaacggagacttcatcatcagtaatgttgacgggaaaggcacagggacctacagttgcagctatcgcgtagagacacatcctaacatgtggtcacatcgcagtgagcccctgaagctgatggggccagcaggctatctcacctggaattacgttctgaatgaagctatcaggttgtctctaatcatgcagcttgttgccttgctgttggtagtgctgtggataaggtggaagtgtcggagactcagaatcagagaagcctggttgctgggaacagctcaaggggtcaccatgctcttcatagtcacggcccttctctgctgtggactgtgcaatggggtattgatagaagagactgaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaactccccttcaagtggtctgagcccagtgagccgctggagcttgtcataaaagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactgacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggcttactccccaaacccagcctattagcccagcctggtcccatggtggcccctggcgaaaatatgactcttcagtgtcaaggggaactgccagactcaacatttgtgctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactgataagccccctaaaccctctctgtcagcctggcccagcaccatgttcaagttagggaaggacatcacccttcagtgccgaggacccctgccaggtgttgaatttgttctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcagggcctgttgctcaggagtgcactgtagggaacattgtccgaagtagcctaatcgtggtggttgttgtagccttgggggtagtgctagccatagagtggaagaagtggcctcgactgcgaaccagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttcaattt

SEQ ID NO: 12391 - DNA, 1437 bp, Homo sapiens; identical to SEQ ID NO: 2876

SEQ ID NO: 12392 - DNA, 1285 bp, Homo sapiens; identical to SEQ ID NO: 455

SEQ ID NO: 12393 - DNA, 2545 bp, Homo sapiens; identical to SEQ ID NO: 440

SEQ ID NO: 12394 - DNA, 1425 bp, Homo sapiens; identical to SEQ ID NO: 416

SEQ ID NO: 12395 - DNA, 1364 bp, Homo sapiens
ctgtattgtggttcctggaacactttagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcagtgtttaagaccactctgtggaggttaatttctgggaccttagggataatatgcctttcgttgatggctacgttgggaattttgttgaaaaattcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacctacatttgagaattataaaattaacataaagaattttgtattttcatttaatgtatataatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaa

SEQ ID NO: 12396 - DNA, 4877 bp, Homo sapiens
gcccgaaacccggaagtgagcggcggcagctgcgaggctcggagaaacaggcgccgcgggctccgcgcccggccggacccgggcccgagatcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggtggccagcaccgcactcgcctccggcagatcctggactggtgtggggaggcctttgagggcgtcatcgtgttcgacgagtgtcacaaagccaagaatgccggctccaccaagatgggcaaggccgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcagccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggatccctgtgcctcctgcagagagacccgcatggccccggggtcctggagcgggtggagcggctgaagcaggatctgctggacaaagtgcgccggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaatgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcctaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaat

SEQ ID NO: 12397 - DNA, 1188 bp, Homo sapiens; identical to SEQ ID NO: 456

SEQ ID NO: 12398 - DNA, 456 bp, Homo sapiens; identical to SEQ ID NO: 422

SEQ ID NO: 12399 - DNA, 660 bp, Homo sapiens
ccacgcgtccgggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacgcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaaaaaaaaaaaaaaa

SEQ ID NO: 12400 - DNA, 487 bp, Homo sapiens
  misc_feature 274, 427, 436, 475, 481: n = A,T,C or G
cagaaaatgccacagtcctcacctcaataaatgagaggacattgtggcagccaaagccacaacttggaagatggggctgcacctgccaacgaagacgggaaatgaccccccccccagcctagtgtgaacctgcccctcgtcccacgtatagaaaaacctcgagtcatggtgaatgagtgtctcggagttgctcgtgtgtgtgtacacctgcgtgcgtgtgtgtgcgtgtgtgcgcgtgtgttcgtgtatgtgcgtgtgtgcgtgcgcgtgtgtntgcattttgcaaagggtggacatttcagtgtatctcccagaaaggtgatgaatgaataggactgagagtcacagtgaatgtgggcatgcatgctggtgtcatgtgacatttgttgagtctcgggcatgttcacggtggggtgggctgtttctnaggcacctncagcagattttcactttgagtgtggggtgtttggtgaanaggcantggagg

SEQ ID NO: 12401 - DNA, 1727 bp, Homo sapiens; identical to SEQ ID NO: 457

SEQ ID NO: 12402 - DNA, 319 bp, Homo sapiens
gcttcggggtcgccgctgggtgagtcccactcccccgcgttgcaggtgacctcactccccggtgcctggcccctgggggccggcagctgcgatcactccagccggtgtggttacagccccactgggctcctccacccgggaccttttgacctcgggctctccagtggaagaggcggaggcagaggcggtggtggcagtggctggggtgtggtggccgtggccgcgacggctgctgctggctccttgggccccacctcgcacacccgggtgaccaccaccggcgcggatgaactcgcttgggtcgcaaggagctgcaaag

SEQ ID NO: 12403 - DNA, 429 bp, Homo sapiens
tttttttttttttttttgaaaacaaaacaaggatttatttgcctacttgctatagcaccttgtaaaacatgtcataaagacgtggaaaacaaggggaaaggattagcctgtctcccacccgacccccctgttcatggctaggtgtggacctgagcactcgtaaaggaacagtgcgggtttagtccctaatcctgacttcgggggcgggaatgccagcaggctgcccagcgctggcacctcaaacacctgctgagggccagtgtttgtctgctggggtctggggcctgaggccaacctggcagtcctgcccaaagccactgggacacttgtagaaatgtaaccactccatgtgccaggagacccaggagacctgccacccccaggaaacccaggagacccaggagacctgccacccccaggagacccagg

SEQ ID NO: 12404 - DNA, 415 bp, Homo sapiens
cggccgcggcgtatgcggaggagattttcggacctgcgacttccgaacaaccctggcaggaggagcggcgttcatccgggggaggcctgaagaaacgctccggggcccagtggctctacccctgctcctgcccgaccctgccgcctccctcacggagccagcggacgggtaggtgaggtgccgtccccccgcgtcccagtgtctccgcaggctgtgtgtagttgggtgcttgggcgcagcgggggccgccacatgctggtcccacgacctcgggcatggccttccctgtccagcctcacggtgtccatcaggcccccctggctgcagaggtgttggccaacgacagtgctggcgtcgatatacctcgccccttcctgcgctcatacctggggccgctctgtgccctttcgccttg

SEQ ID NO: 12405 - DNA, 5270 bp, Homo sapiens
ggaaacaaaaacaacaccatatatttatgaacctcagtgaaccagcctagaaaaattgacttctgcaggtgctaaagcacctactaatacgcagcatgcacagcatttcaggttgtgaataccattttacaacgagtttgctgttaactctctttatccaatgcaaacttgaaattctgatgcggttttccagggtggtattttttcagagtattgaatttactatttagtaatttatagtatagctttttatattaaaatgtgatatttttaaaagagatatctggttcaattggtataatgacgtgattatgcaatatgctgatctacaccttgcgctcacattgtgccaaacttaaatgtgcaagtgtacgtgagaaaagcacatgtgaatgtgaattctttaattctttgcttattatgttaaaattagtcttcatagtccactgatgtgtatgcttgaataatgtctatttactttggaatttcaagatttccagcttcaatggtaatttataatttctcagatcaccttaagaaatattgagatactctcccacctgaaaataatctgttctttaacccacctgactatgggagtagccaggcaggtgcctcactggcttcttcagacgaggcttcctcaggtggatatatgactattaggggaaaagaggcttttgagacagcttattacctccttcccctttttgaactaagtacattgtctcagtcccagtatgaatttgtcccatttggggtatttttaaaataaaagatggctaacatggaatctggggcatagccttggcctttaattatggttgtaagcccaaataatggcagagaaacacagggctgtttttacaacagaaaactcaatataagttttatataagaatcctataaaatttgaaccagagctcctatttagttgttataatgtctcctaaagatcttaaatgcttctaaaagctaattattattccagagcaactttttccttttcccccttataaagtttttttttaaatccaaaatcttagatttctgtgccacagcaaaataaaatgatcaacaattaaagatctgtacttaaaatagtacaccatttttagtggagggagggtgcatgcctatatgatggtaagattcttttgaactctaaggacaattcctcatggaaaaaataaatttcagtgcatattataaaaatgatttgcactgtgttagcaaaataaggtgttttaggttgtattttaaagacaattctaaatcatttctctggaaagcaagaccttaaattcttctctttaatagaactgcttttatgcaaagagatggtcttaacatggactaaacagtacataacaataatgtttgttatgtaaatagtatatcacatttgcttagtagcacaattcaacagcaggctgaaagtcgtggctcctctgctcagattgagttttaagttacctaatttatgtaatcagaatctattctaggtggccgtcaacgtaaactgtgtttccctattatatccctctggagactgagaatcaaattaaatagtctttcttcaaagcagtactgtaacatgaatgtatttatctcagtcaacagaacttatatgcccactgtatgtggagcttatttcaatgctaatttggcttagttagcagacctagaatctgcccaggtgagacctagaacaaaaatagctggggtgaaatggataagagaggtagaggtatatgtcaaggcagagccctatgaggaaggaagagttttcaaagaatatgaggaacatagtgctgagagtgtggctgccttcagcaccgtacacctaatctagagaaaatatttcccatgtgggaggtcctgtctgcattcagtccacccttttctgcctgcttcttcctccaagtgcctcaacctctacatgctcactctcctccccttccctcagcccatcttggtctaagcagctttcacaatccaaaccaaacatcaccagccacccgctgataagtcaccagcatttacttccctgagttactttttctccattcattgagactatggattcatcccaactccttctaaatccctcaaccatccagctatattttggctaacctttgccctagacactctaccagatgttaatgcagtatcaagtgtaaattgtgtcaccctattctgttctacccttttccctgctgccgaaatatcttgctctcctctacctcatccccaaagagcctataaattcagagtatccaaccttttcatggattcactcactgttgttcagtaatacaacttccatattttaaataaatcataaaagatttttgccttctatcaaagtaggaaactttatatttatacatgatacagaaattgaactatttctatcgttcagaatttagcatataacaggattttaaagtgattgaattgccatcctaacttggatttgtattaggttatgaatgaatactgttgttagtccaagctatttgaatgtaaagttaaaattctccagcaatccagaatgacttgtaacccttcagtggaatgggaaatttctggtatgcaaatagggtggtgttccagacatttgttttattggtggtgtttgggccttgaaacacatttctaatagaatgacatatggcaaagggtatttagatggtcctatgggatcacagaagcccatatgatttaaaatatagataaaataacacaaaattgggtacataagggtttaaccaggctttcctgggttagactaagcctctaacctctgttcctatcctgttcttatgggaggaaaaaaaatgttccatgggatgaaaagaaaatgcattgactttgtagtctttattctcctagccgcacttcgggtatatccagaaggaagaggaaatgcaaagaggaagaagatgtaatagttcttctctccagctaggtgcacttgaggttgttcataaatgtaaaattatgtcaggtttctaacatgggacactgcacacagttgtctgacctgatgaaccatcccatttgaaagtatagattattattatttcttgtagtatttggttgttttccatctcattcatgaacaactcaacctgatagtagtatccaataaatgcctttcagggctcaggaatgaattgacatcctagttaagaaatgagacttaataatggagactgaggcggtttgtattaaattatatgccatgaagtgttcattttagctttaacctaattatgactgtaccaccatgaagtacagaatgaaaaattatatatatgggggggaaacagaatgaatatctgattcttttgaatgcttgtggaaatctttgagatcgtgcagggcataccacaaaatagcctttagaacagatacccaattttacagttcataggacaacatcaaacattagtaagtctaaataagatgaatagaatttttgttatgtaaattttgctagaacagtctattttcttgcaccccctcaagttaacctcttaaaaaaatgaatgtataatttctaccgaaagaatatcagagagaatctctctggcctatagtgttaaaatattgttcacaaatcctgattagttaagtgcatacattatgaaacttacagaataaaacttattatacatctctttcttaaattaatatctttacacattttcaactggctccccaagtctgataaggaaggattaaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccaaactatatatctagtgcagatatttcctttgcattattcagtcttctctggagagaaaatacagtttccccttcctctttctcttcacatttactcttttcaacccaaaataagagacatagaaagcaaaccacagccagtttggcatcttctcagtgctactagtataggcacatacacatacacagtctcagcaaggttataaagaaccctgtcaggtccacttgcaacatggccttgctacttggattagctcctttaagcctgaaaataactttcctggtcatggaagaactggacgcatcttttaacttatgaaatagaagttgaacttgaaaactctttttaaaaaatcctggttttgcaggacagctacataatgaatgtatatattaagactgtagctgaattgcacatgaaatcagattgccaacttcttgactttcaatgttagacatttatccttaagttgtgagcgatatatgtagcatgctgtgaaatgtctgttatagctctttaattcatcagtattaatacagaattatcatttgcgtttcttggtactttttattcaatgtaatcagaagctgtgatgttttgcctttgtagtcctgtgctttgttactgtaattttttttttttttttttacgaagcacgtgactggactaatgtaaggcagatgacgtgatctttaagactgctatatatatcagtctcttactctataaggttttaaattagaataagcttttatcaaatagataattgatgcaatttaggattcacgcaagtttcagtgtcaaatggcggtcttatagtttcaattctgaaaatagcaaacttaataaacagccactttaaacttgttctggcaaaccagaccctgctgtagatatagtctaaggtagttaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctatttataggtacagaacaatgggttttgttaaactgtatcacatttatacttgcagaaatttatttcattgttattagtaggaattttattggttcaataaaattggcaaaactgaaaaaaaaaaa

SEQ ID NO: 12406 - DNA, 557 bp, Homo sapiens; identical to SEQ ID NO: 2903

SEQ ID NO: 12407 - DNA, 116 bp, Homo sapiens; identical to SEQ ID NO: 437

SEQ ID NO: 12408 - DNA, 2756 bp, Homo sapiens
atgcagttaggggagcagctcttggtgagctcagtgaacctgcctggcgcgcacttctacccgctggagagtgcgcgaggcggcagcggcgggagcgctggccacctccccagcgcggccccctctcctcagaagttggacttagacaaagcgtccaagaagttttccggcagtctctcctgcgaggcggtgagcggggagcccgcagccgccagcgcaggggcccccgcggccatgcttagtgacaccgacgccggggacgcatttgccagcgctgcggcagtggccaagccggggcccccggacggccgcaagggctccccctgcggggaggaggagctgccctccgccgctgcagccgccgccgccgccgccgccgcggctgcggccactgcgcgctactccatggacagcctgagctccgagcggtactacctccagtcccccggtcctcaggggtcggagctggctgcgccctgctcactcttcccgtaccaggcggcggctggggcgccccacggacctgtgtacccggctcctaacggggcgcgctacccctacggctccatgctgccccccggcggcttccccgcggctgtgtgcccacccgggagggcgcagttcggcccaggagccggtgcgggcagtggcgcgggcggtagcagcggcgggggcggcggcccgggcacctatcagtacagccagggggctccgctctacgggccgtaccctggagccgcagcggcgggatcttgcggaggactggggggcctgggggttccaggttctggcttccgtgcccacgtctacctgtgcaaccggcctctgtggctcaaattccaccgccaccaaactgagatgatcattacgaaacagggcaggcgcatgtttcctttcttgagcttcaacataaacggactcaatcccactgcccactacaatgtgttcgtagaggtggtgctggcggaccccaaccactggcgcttccaggggggcaaatgggtgacctgtggcaaagccgacaataacatgcagggcaacaaaatgtatgttcacccagagtctcctaatactggttcccactggatgagacaggagatttcattcgggaaattaaaactcaccaataacaaaggcgcaaataacaacaacacccagatgatagtcttacaatccttacacaaataccaaccccgactgcatattgttgaagttacagaggatggcgtggaggacttgaatgagccctcaaagacccagacttttaccttctcagaaacgcaattcattgcagtgactgcctaccaaaacaccgatattactcaactaaagattgatcataacccctttgcaaaaggcttcagagacaactatgattcatcccatcagattgtccctggaggtcggtacggcgttcaatccttcttcccggagccctttgtcaacactttacctcaagcccgctattataatggcgagagaaccgtgccacagaccaacggcctcctttcaccccaacagagcgaagaggtggccaaccctccccagcggtggcttgtcacgcctgtccagcaacctgggaccaacaaactagacatcagttcctatgaatctgaatatacttctagcacattgctcccatatggcattaaatccttgccccttcagacatcccatgccctggggtattacccagacccaacctttcctgcaatggcagggtggggaggtcgaggttcttaccagaggaagatggcagctggactaccatggacctccagaacaagccccactgtgttctctgaagatcagctctccaaggagaaagtgaaagaggaaattggctcttcttggatagagacacccccttccatcaaatctctagattccaatgattcaggagtatacaccagtgcttgtaagcgaaggcggctgtctcctagcaactccagtaatgaaaattcaccctccataaagtgtgaggacattaatgctgaagagtatagtaaagacacctcaaaaggcatgggagggtattatgctttttacacaactccctaaagagttattttaacctcaaaaattagctaactttttgcagatggacttggtggtgttttttgttgtcttctttgcctaggttgccaaaaagatgtttgccttccaccttgatgcatcctgttttgtgcaattctctaaaagaaggtgccaaagctttttgattgctgcaggtaactgaaacaaacctagcatttttaaaaaataagattaatggaagactttaaggtattttaaaattcgaagggtatccaaggttctgtatttatttattggggagacactaacccttcaaagaagcaggctgtgaacattgggtgcccagtgctatcagatgagttaaaacctttgattctcatttctatttgtaaattcttaagcaaatagaagccgagtgttaaggtgttttgcttctgaaagagggctgtgccttccgtttcagaaggagacattttgctgttacattctgccaggggcaaaagatactaggcccaggagtcaagaaaagcttttgtgaaagtgatagtttcacctgactttgattccttaacccccggcttttggaacaagccatgtttgccctagtccaggattgcctcacttgagacttgctaggcctctgctgtgtgctggggtggccagtgggactcaggagagagcaagctaaggagtcaccaaaaaaaaaaaaaaaaaaaaaa

SEQ ID NO: 12409 - DNA, 1222 bp, Homo sapiens
agctcagcaggacctcagccatgagacttctcatcctggccctccttggcatctgctctctcactgcatacattgtggaaggtgtagggagtgaagtctcagataagaggacctgtgtgagcctcactacccagcgactgccggttagcagaatcaagacctacaccatcacggaaggctccttgagagcagtaatttttattaccaaacgtggcctaaaagtctgtgctgatccacaagccacatgggtgagagacgtggtcaggagcatggacaggaaatccaacaccagaaataacatgatccagaccaagccaacaggaacccagcaatcgaccaatacagctgtgactctgactggctagtagtctctggcaccctgtccgtctccagccagccagctcatttcactttacacgctcatggactgagtttatactcaccttttatgaaagcactgcatgaataaaattattcctttgtatttttacttttaaatgtcttctgtattcacttatatgttctaattaataaattatttattattaagaatagttccctagtctattcattatatttagggaaaggtagtgtatcattgttgtttgatttctgaccttgtacctctctttgatggtaaccataatggaagagattctggctagtgtctatcagaggtgaaagctatatcaatctctcttagagtccagcttgtaatggttctttacacatcagtcacaagttacagctgtgacaatggcaacaatttgagatgtatttcaacttgtctctataatagaattctgtttatagaataagggagaaaataatccagtcttcactgggttcccattctgagggtccactactcaaaaatttgcttcactcaatttttttcacctctttgtgttttattttggtgtcctattaaaggaataaaatgacacaacttgtcccttttttgtcccattagcaaaaattagaattttggtataaagaaactttattcaagtaaaaatcaataccctttgaattggacaataatctcactaccttattaggatttctgtatttgccattacgctagttatcatgcatgttatgctttactgcgaataagcttttaatgctccaaatgctgacccatgcaatatttcctcatgtgatcacaatttgcagtaaacttttaattaaatgctcatctggtaactcaacaccccag

SEQ ID NO: 12410 - DNA, 925 bp, Homo sapiens; identical to SEQ ID NO: 336

SEQ ID NO: 12411 - DNA, 1959 bp, Homo sapiens
cggacgcgtgggcagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagcaaaaaaaaaaaaaaaaaaaa

SEQ ID NO: 12412 - DNA, 2108 bp, Homo sapiens
ggttttctccccgcttgccggggtggtcctcttccctttgtcggaccaaagaagtaaacactgtgtggagagggactgacgtgtttggagggaaatgggaatgtacacgataattaaagagtaaagttgtgctcaacgctgtttacttctaattatttcctgattcacaaattaatttttgcaattcacaacttcaagaatacttggactattggattcaatccatagtaatctgcaaaagaagagaagcagaattatacctagaagtctactaatggacagttagtcacccacctacatgttgagattcctgacattcagacaactgacttgtaactgacttataactgacttgtaatacactgctactatatcaaaccgacaatgaattggaatgaaaaaccaaagagtgctacattaccaccactgtatcctaaaagccagccaccttttttgcaccagtctttaataaaccaaattaccacaacatctcagagttctttcagctatcctggaagtaaccaagaagcatgcatgtatcccggtaattcaaatccaatttcacagccactgctgaatatccaaaattatcctcaacaaatttctgtttctgatatgcataatgggacagttgtggcctcacacacttcagtagaaagaataacatatgcaaatgttaatggacccaaacaactaactcacaatttgcagatgtcttcaggagttacccaaaatgtatggttgaactcaccaatgaggaatcctgtgcattctcatataggggcaactgtatctcatcaaactgattttggagctaacgtacccaatatgccggcactacagagtcaactgataacatcagatacctattctatgcaaatgcagatgatcccttctaattctacacgacttcctgtagcttaccaaggaaatcagggacttaaccagtctttttcagagcaacaggttgattggacacaacagtgtatatctaagggactgacttacccagattacagaccacctccaaagctataccgttactcaccacaaagctttttaccagattctaccattcaaaaacaaaactttataccacatacatcattgcaagttaaaaatagtcagcttccaaattctgtattaactttaccatcaaggcagacctcagctgtaccatcacagcagtatgccacgcaaactgacaaaagacctcctcctcctccttacaactgtagatatggaagccagcctttgcaaagtactcagcatattactaaacacttgtctatggaagttcctcagagtcgagaaatgctgtcatctgaaataaggaccagctttcaacagcagtggcaaaaccctaatgaaaatgtcagcacaattggaaatttcactaacttgaaagtaaataccaacagcaaacagccttttaacagtcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatacttcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagacccatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccatgtccactgaggaatataaatc

SEQ ID NO: 12413 - DNA, 169 bp, Homo sapiens; identical to SEQ ID NO: 459

SEQ ID NO: 12414 - DNA, 1592 bp, Homo sapiens
ggagagatgatgagttgctgagtgtgcacacctttccggaacacatacacacaccctgctctgggatcccttgtgaggctgccctcatggagttccccctggcccagatatgtccccaagggagtcacgaagcccccatcccaaccttcagcaccttccagatcacagacatgacccgcaggagctgccagaacctgggctacactgcggcatctccccaggccccggaggctgcctccagcacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggagggaggcagagaggctgctggagcccaagcctcaggggtgctacttggtgcggttcagcgagagcgcggtgaccttcgtgctgacttacaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggagccctcccagctgctcaggcccaagcctcccatccccgccaaacctcagctgcccccagaagtctacacaatccctgttccacgacaccgcccggccccacgccccaagccctccaatcctatctacaatgagcctgatgaacccatagctttctatgccatgggccggggcagccctggggaagcccccagcaacatctatgtggaagtggaagatgagggcctacccgccacccttgggcaccctgtcctacggaagagctggtccaggcctgtcccaggaggccagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctacagggaaa

SEQ ID NO: 12415 - DNA, 7274 bp, Homo sapiens
atggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccagggcgagctggagcggcagctgctgcaggccaaccccatcctggaggccttcgggaacgccaagaccgtgaagaatgacaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggctctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgctacga

SEQ ID NO: 12416 - DNA, 916 bp, Homo sapiens; identical to SEQ ID NO: 2921

SEQ ID NO: 12417 - DNA, 369 bp, Homo sapiens
  misc_feature 84, 211, 223, 282, 297, 352: n = A,T,C or G
acttttttttttttttttttttttttcaacagctaagccaagggtccaagtagcacttcaaaagcacaacgaattgcacaaaanaaccctgcagtttgttaattttctgtgccagcccttggcatttttatggtgtagttcaagtctaataacattttaagtgcttcatcttttcatattttttccccacgttgttcccaggacacaaganaatgagtggcanaagattactaattgaaaaagaagaaaaataataattaaaatgcaagactgaagacatantaattgacgcatcanaaaattacctgctttgcatgctctccatcgtcaaagtcttctggaaacttaggcnaagtgggctaaaaaaat

SEQ ID NO: 12418 - DNA, 568 bp, Homo sapiens; identical to SEQ ID NO: 451

SEQ ID NO: 12419 - DNA, 2566 bp, Homo sapiens
aagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggctccgctctgcaatggcagcatggtatggagcatcaacctgacagctggcatgtactgtgcagccctggaatccctgatcaacgtgtcaggctgcagtgccatcgagaagacccagaggatgctgagcggattctgcccgcacaaggtctcagctgggcagttttccagcttgcatgtccgagacaccaaaatcgaggtggcccagtttgtaaaggacctgctcttacatttaaagaaactttttcgcgagggacggttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctggcacttggagccaagggttcagagactcagggccccagcactaaagcagtggaccccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttcctcgtatttaaatattaaatatgttagcaaagagttaatatatagaagggtaccttgaacactgggggaggggacattgaacaagttgtttcattgactatcaaactgaagccagaaataaagttggtgacagataaagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggctccgctctgcaatggcagcatggtatggagcatcaacctgacagctggcatgtactgtgcagccctggaatccctgatcaacgtgtcaggctgcagtgccatcgagaagacccagaggatgctgagcggattctgcccgcacaaggtctcagctgggcagttttccagcttgcatgtccgagacaccaaaatcgaggtggcccagtttgtaaaggacctgctcttacatttaaagaaactttttcgcgagggacggttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctggcacttggagccaagggttcagagactcagggccccagcactaaagcagtggaccccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttcctcgtatttaaatattaaatatgttagcaaagagttaatatatagaagggtaccttgaacactgggggaggggacattgaacaagttgtttcattgactatcaaactgaagccagaaataaagttggtgacagata

SEQ ID NO: 12420 - DNA, 1869 bp, Homo sapiens; identical to SEQ ID NO: 333

SEQ ID NO: 12421 - DNA, 1432 bp, Homo sapiens; identical to SEQ ID NO: 463

SEQ ID NO: 12422 - DNA, 1620 bp, Homo sapiens
tgggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccctaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccattgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggccttaaaaaaaaaaaaaaaaaaaaaaaaaaaaaaaaaaaaaaaaaaaaaaaaaaaaaaaaaaaaaaaa

SEQ ID NO: 12423 - DNA, 2073 bp, Homo sapiens; identical to SEQ ID NO: 464

SEQ ID NO: 12424 - DNA, 1124 bp, Homo sapiens; identical to SEQ ID NO: 465

SEQ ID NO: 12425 - DNA, 1066 bp, Homo sapiens; identical to SEQ ID NO: 466

SEQ ID NO: 12426 - protein, 162 aa, Homo sapiens; identical to SEQ ID NO: 2499

SEQ ID NO: 12427 - protein, 555 aa, Homo sapiens; identical to SEQ ID NO: 2475

SEQ ID NO: 12428 - protein, 155 aa, Homo sapiens; identical to SEQ ID NO: 2498

SEQ ID NO: 12429 - protein, 99 aa, Homo sapiens; identical to SEQ ID NO: 2471

SEQ ID NO: 12430 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 12431 - protein, 115 aa, Homo sapiens
MPMFIVNTNVPRASVPDGFLSELTQQLAQATGKPPQYIAVHVVPDQLMAFGGSSEPCALCSLHSIGKIGGAQNRSYSKLLCGLLAERLRISPDRVYINYYDMNAANVGWNNSTFA

SEQ ID NO: 12432 - protein, 107 aa, Homo sapiens; identical to SEQ ID NO: 2506

SEQ ID NO: 12433 - protein, 261 aa, Homo sapiens
MFEARLVQGSILKKVLEALKDLINEACWDISSSGVNLQSMDSSHVSLVQLTLRSEGFDTYRCDRNLAMGVNLTSMSKILKCAGNEDIITLRAEDNADTLALVFEAPNQEKVSDYEMKLMDLDVEQLGIPEQEYSCVVKMPSGEFARICRDLSHIGDAVVISCAKDGVKFSASGELGNGNIKLSQTSNVDKEEEAVTIEMNEPVQLTFALRYLNFFTKATPLSSTVTLSMSADVPLVVEYKIADMGHLKYYLAPKIEDEEGS

SEQ ID NO: 12434 - protein, 199 aa, Homo sapiens; identical to SEQ ID NO: 2487

SEQ ID NO: 12435 - protein, 369 aa, Homo sapiens; identical to SEQ ID NO: 2966

SEQ ID NO: 12436 - protein, 1822 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPTAPRTTAARAGRAAAVPRSATPGPPGEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 12437 - protein, 166 aa, Homo sapiens; identical to SEQ ID NO: 2501

SEQ ID NO: 12438 - protein, 352 aa, Homo sapiens; identical to SEQ ID NO: 2486

SEQ ID NO: 12439 - protein, 156 aa, Homo sapiens
MYRMQLLSCIALILALVTNSAPTSSSTKKTKKTQLQLEHLLLDLQMILNGINNYKNPKLTRMLTFKFYMPKKATELKQLQCLEEELKPLEEVLNLAQSKNFHLRPRDLISNINVIVLELKGSETTFMCEYADETATIVEFLNRWITFCQSIISTLT

SEQ ID NO: 12440 - protein, 556 aa, Homo sapiens
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCVPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLGSQSYEDMRGILYAAPQLRSIRGQPGPNHEEDADSYENMDNPDGPDPAWGGGGRMGTWSTR

SEQ ID NO: 12441 - protein, 119 aa, Homo sapiens; identical to SEQ ID NO: 2402

SEQ ID NO: 12442 - protein, 1417 aa, Homo sapiens
MGAMEINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLRKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 12443 - protein, 586 aa, Homo sapiens
MRPLPGALGVAAAALWLLLLLLPRTRADEHEHTYQDKEEVVLWMNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLGSKYYNPDVIFSKMEKSDVKFEDRFDNILIVLFSHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMGVHCLLHQFHSHLLPCFKSHSFWNNGGRLLHLFFCYSSSKSCWYNTWPKSVRSAQLSLSCQCCASSYTGEKMVHGAAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 12444 - protein, 453 aa, Homo sapiens; identical to SEQ ID NO: 2485

SEQ ID NO: 12445 - protein, 320 aa, Homo sapiens
MQRPNAHRISQPIRQIIYGLLLNASPHLDKTSWNALPPQPLAFSEVERINKNIRTSIIDAVELAKDHSDLSRLTELSLRRRQMLLLETLKVKQTILEPIPTSLKLPIAVSCYWLQHTETKAKLHHLQSLLLTMLVGPLIAIINSPGKEELQEDGAKMLYAEFQRVKAQTRLGTRLDLDTAHIFCQWQSCLQMGMYLNQLLSTPLPEPDLTRLYSGSLVHGLCQQLLASTSVESLLSICPEAKQLYEYLFNATRSYAPAEIFLPKGRSNSKKKRQKKQNTSCSKNRGRTTAHTKCWYEGNNRFGLLMVENLEEHSEASNIE

SEQ ID NO: 12446 - protein, 798 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 12447 - protein, 254 aa, Homo sapiens
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGVRKSNAAERRGPL

SEQ ID NO: 12448 - protein, 223 aa, Homo sapiens; identical to SEQ ID NO: 2478

SEQ ID NO: 12449 - protein, 235 aa, Homo sapiens; identical to SEQ ID NO: 2479

SEQ ID NO: 12450 - protein, 266 aa, Homo sapiens; identical to SEQ ID NO: 2502

SEQ ID NO: 12451 - protein, 91 aa, Homo sapiens; identical to SEQ ID NO: 2488

SEQ ID NO: 12452 - protein, 178 aa, Homo sapiens; identical to SEQ ID NO: 2500

SEQ ID NO: 12453 - protein, 651 aa, Homo sapiens; identical to SEQ ID NO: 2401

SEQ ID NO: 12454 - protein, 272 aa, Homo sapiens; identical to SEQ ID NO: 2493

SEQ ID NO: 12455 - protein, 147 aa, Homo sapiens; identical to SEQ ID NO: 2481

SEQ ID NO: 12456 - protein, 153 aa, Homo sapiens [sequence omitted]

SEQ ID NO: 12457 - protein, 808 aa, Homo sapiens; identical to SEQ ID NO: 2484

SEQ ID NO: 12458 - protein, 233 aa, Homo sapiens [sequence omitted]

SEQ ID NO: 12459 - protein, 281 aa, Homo sapiens; identical to SEQ ID NO: 2473

SEQ ID NO: 12460 - protein, 163 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12461 - protein, 134 aa, Homo sapiens
MRMLLHLSLLALGAAYVYAIPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 12462 - protein, 177 aa, Homo sapiens
MFHVSFRYIFGLPPLILVLLPVASSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 12463 - protein, 375 aa, Homo sapiens; identical to SEQ ID NO: 2400

SEQ ID NO: 12464 - protein, 789 aa, Homo sapiens; identical to SEQ ID NO: 2512

SEQ ID NO: 12465 - protein, 98 aa, Homo sapiens; identical to SEQ ID NO: 2497

SEQ ID NO: 12466 - protein, 266 aa, Homo sapiens; identical to SEQ ID NO: 2978

SEQ ID NO: 12467 - protein, 1170 aa, Homo sapiens; identical to SEQ ID NO: 3007

SEQ ID NO: 12468 - protein, 512 aa, Homo sapiens; identical to SEQ ID NO: 2492

SEQ ID NO: 12469 - protein, 94 aa, Homo sapiens; identical to SEQ ID NO: 3011

SEQ ID NO: 12470 - protein, 126 aa, Homo sapiens
MPEPAKSAPAPKKGSKKAVTKAQKKDGKKRKRSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 12471 - protein, 208 aa, Homo sapiens
MDPFLVLLHSVSSSLSSSELTELKFLCLGRVGKRKLERVQSGLDLFSMLLEQNDLEPGHTELLRELLASLRRHDLLRRVDDFEAGAAAGAAPGEEDLCAAFNVICDNVGKDWRRLARQLKVSDTKIDSIEDRYPRNLTERVRESLRIWKNTEKENATVAHLVGALRSCQMNLVADLVQEVQQARDLQNRSGAMSPMSWNSDASTSEAS

SEQ ID NO: 12472 - protein, 314 aa, Homo sapiens
MGLEAARELECAALGTLLRDPREAERTLLLDCRPFLAFCRRHVRAARPVPWNALLRRRARGPPAAVLACLLPDRALRTRLVRGELARAVVLDEGSASVAELRPDSPAHVLLAALLHETRAGPTAVYFLRGGFDGFQGCCPDLCSEAPAPALPPTGDKTSRSDSRAPVYDQGGPVEILPYLFLGSCSHSSDLQGLQACGITAVLNVSASCPNHFEGLFRYKSIPVEDNQMVEISAWFQEAIGFIDWVKNSGGRVLVHCQAGISRSATICLAYLMQSRRVRLDEAFDFVKQRRGVISPNFSFMGQLLQFETQVLCH

SEQ ID NO: 12473 - protein, 386 aa, Homo sapiens; identical to SEQ ID NO: 2930

SEQ ID NO: 12474 - protein, 210 aa, Homo sapiens; identical to SEQ ID NO: 2503

SEQ ID NO: 12475 - protein, 830 aa, Homo sapiens; identical to SEQ ID NO: 2474

SEQ ID NO: 12476 - protein, 359 aa, Homo sapiens; identical to SEQ ID NO: 2932

SEQ ID NO: 12477 - protein, 344 aa, Homo sapiens; identical to SEQ ID NO: 2483

SEQ ID NO: 12478 - protein, 501 aa, Homo sapiens
METILEQQRRYHEEKERLMDVMAKEMLTKKSTLRDQINSDHRTRAMQDRYMEVSGNLRDLYDDKDGLRKEELNAISGPNEFAEFYNRLKQIKEFHRKHPNEICVPMSVEFEELLKARENPSEEAQNLVEFTDEEGYGRYLDLHDCYLKYINLKASEKLDYITYLSIFDQLFDIPKERKNAEYKRYLEMLLEYLQDYTDRVKPLQDQNELFGKIQAEFEKKWENGTFPGWPKETSSALTHAGAHLDLSAFSSWEELASLGLDRLKSALLALGLKCGGTLEERAQRLFSTKGKSLESLDTSLFAKNPKSKGTKRDTERNKDIAFLEAQIYEYVEILGEQRHLTHENVQRKQARTGEEREEEEEEQISESESEDEENEIIYNPKNLPLGWDGKPIPYWLYKLHGLNINYNCEICGNYTYRGPKAFQRHFAEWRHAHGMRCLGIPNTAHFANVTQIEDAVSLWAKLKLQKASERWQPDTEEEYEDSSGNVVNKKTYEDLKRQGLL

SEQ ID NO: 12479 - protein, 216 aa, Homo sapiens
MGWIRGRRSRHSWEMSEFHNYNLDLKKSDFSTRWQKQRCPVVKSKCRENASPFFFCCFIAVAMGIRFIIMVAIWSAVFLNSLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTV

SEQ ID NO: 12480 - protein, 547 aa, Homo sapiens
MAEPSGSPVHVQLPQQAAPVTAAAAAAPAAATAAPAPAAPAAPAPAPAPAPAAQAVGWPICRDAYELQEVIGSGATAVVQAALCKPRQERVAIKRINLEKCQTSMDELLKEIQAMSQCSHPNVVTYYTSFVVKDELWLVMKLLSGGSMLDIIKYIVNRGEHKNGVLEEAIIATILKEVLEGLDYLHRNGQIHRDLKAGNILLGEDGSVQIADFGVSAFLATGGDVTRNKVRKTFVGTPCWMAPEVMEQVRGYDFKADMWSFGITAIELATGAAPYHKYPPMKVLMLTLQNDPPTLETGVEDKEMMKKYGKSFRKLLSLCLQKDPSKRPTAAELLKCKFFQKAKNREYLIEKLLTRTPDIAQRAKKVRRVPGSSGHLHKTEDGDWEWSDDEMDEKSEEGKAAFSQEKSRRVKEENPEIAVSASTIPEQIQSLSVHDSQGPPNANEDYREASSCAVNLVLRLRNSRKELNDIRFEFTPGRDTADGVSQELFSAGLVDGHDVVIVAANLQKIVDDPKALKTLTFKLASGCDGSEIPDEVKLIGFAQLSVS

SEQ ID NO: 12481 - protein, 191 aa, Homo sapiens; identical to SEQ ID NO: 2941

SEQ ID NO: 12482 - protein, 535 aa, Homo sapiens
MGIVEPGCGDMLTGTEPMPGSDEGRAPGADPQHRYFYPEPGAQDADERRGGGSLGSPYPGGALVPAPPSRFLGAYAYPPRPQAAGFPGAGESFPPPADAEGYQPGEGYAAPDPRAGLYPGPREDYALPAGLEVSGKLRVALNNHLLWSKFNQHQTEMIITKQGRRMFPFLSFTVAGLEPTSHYRMFVDVVLVDQHHWRYQSGKWVQCGKAEGSMPGNRLYVHPDSPNTGAHWMRQEVSFGKLKLTNNKGASNNVTQMIVLQSLHKYQPRLHIVEVNDGEPEAACNASNTHIFTFQETQFIAVTAYQNAEITQLKIDNNPFAKGFRENFESMYTSVDTSIPSPPGPNCQFLGGDHYSPLLPNQYPVPSRFYPDLPGQAKDVVPQAYWLGAPRDHSYEAEFRAVSMKPAFLPSAPGPTMSYYRGQEVLAPGAGWPVAPQYPPKMGPASWFRPMRTLPMEPGPGGSEGRGPEDQGPPLVWTEIAPIRPESSDSGLGEGDSKRRRVSPYPSSGDSSSPAGAPSPFDKEAEGQFYNYFPN

SEQ ID NO: 12483 - protein, 1878 aa, Homo sapiens
MEMEANEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQKFWANGTHSPMGLNFDSQELYDSFPDQNFEEVCSGIHPDEAAEKEMTSVVAENGTGLVCSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNLVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECLTTIQGQARNKRKQETKSLKHKEAKKKSKAEKEKGKTKQEKLKEKVKREKKEKVKMKEKEEVTKAKPACKADKTLATQRRLEERQKQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFPVHELNGSTLIINEIDKTLESMSSYRKNKWIVEGRLRRLKTVLAKRTGRSEVEMGRPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARSRPLKTKPGFMQPRHFKSPVRGQDSEQPQAQLQPEAQLHVPAQPQPQLQLQLQSHKGFLEQEGSPLSLGQSQHDLSQSAFLSWLSQTQSHSSLLSSSVLTPDSSPGKLDPAPSQPPEEPEPDEAESSPDLQAFWFNISAQMPCNAAPTPPLAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIPDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGPGREGLAPQRKTTNPLDLAVMRLAALEQNVKRRYLREPLWPTHEVVLEKALLSTPNGAPEGTTTEISYEITPRIRIWRQTLQRCRSAAHVCLCLGHLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLKGRESPAAGPRYSEERLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 12484 - protein, 231 aa, Homo sapiens; identical to SEQ ID NO: 2491

SEQ ID NO: 12485 - protein, 532 aa, Homo sapiens; identical to SEQ ID NO: 2495

SEQ ID NO: 12486 - protein, 823 aa, Homo sapiens; identical to SEQ ID NO: 2946

SEQ ID NO: 12487 - protein, 604 aa, Homo sapiens; identical to SEQ ID NO: 2510

SEQ ID NO: 12488 - protein, 259 aa, Homo sapiens; identical to SEQ ID NO: 2482

SEQ ID NO: 12489 - protein, 212 aa, Homo sapiens; identical to SEQ ID NO: 2489

SEQ ID NO: 12490 - protein, 297 aa, Homo sapiens; identical to SEQ ID NO: 2997

SEQ ID NO: 12491 - protein, 92 aa, Homo sapiens; identical to SEQ ID NO: 2494

SEQ ID NO: 12492 - protein, 247 aa, Homo sapiens; identical to SEQ ID NO: 2472

SEQ ID NO: 12493 - protein, 558 aa, Homo sapiens; identical to SEQ ID NO: 2507

SEQ ID NO: 12494 - protein, 782 aa, Homo sapiens
MAPHRPAPALLCALSLALCALSLPVRAATASRGASQAGAPQGRVPEARPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 12495 - protein, 458 aa, Homo sapiens; identical to SEQ ID NO: 2504

SEQ ID NO: 12496 - protein, 368 aa, Homo sapiens; identical to SEQ ID NO: 2505

SEQ ID NO: 12497 - protein, 1336 aa, Homo sapiens
MTLDRPGEGATMLKTFTVLLFCIRMSLGMTSIVMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGLYPKPTLTAHPGPIMAPGESLNLRCQGPIYGMTFALMRVEDLEKSFYHKKTIKNEANFFFQSLKIQDTGHYLCFYYDASYRGSLLSDVLKIWVTDTFPKTWLLARPSAVVQMGQNVSLRCRGPVDGVGLALYKKGEDKPLQFLDATSIDDNTSFFLNNVTYSDTGIYSCHYLLTWKTSIRMPSHNTVELMVVDKPPKPSLSAWPSTVFKLGKAITLQCRVSHPVLEFSLEWEERETFQRFSVNGDFIISNVDGKGTGTYSCSYRVETHPNMWSHRSEPLKLMGPAGYLTWNYVLNEAIRLSLIMQLVALLLVVLWIRWKCRRLRIREAWLLGTAQGVTMLFIVTALLCCGLCNGVLIEETEIVMPTPKPELWAETNFPLAPWKNLTLWCRSPSGSTKEFVLLKDGTGWIATRPASEQVRAAFPLGALTQSHTGSYHCHSWEEMAVSEPSEALELVGTDILPKPVISASPTIRGQELQLRCKGWLAGMGFALYKEGEQEPVQQLGAVGREAFFTIQRMEDKDEGNYSCRTHTEKLPFKWSEPSEPLELVIKEMYPKPFFKTWASPVVTPGARVTFNCSTPHQHMSFILYKDGSEIASSDRSWASPGASAAHFLIISVGIGDGGNYSCRYYDFSIWSEPSDPVELVVTEFYPKPTLLAQPGPVVFPGKSVILRCQGTFQGMRFALLQEGAHVPLQFRSVSGNSADFLLHTVGAEDSGNYSCIYYETTMSNRGSYLSMPLMIWVTDTFPKPWLFAEPSSVVPMGQNVTLWCRGPVHGVGYILHKEGEATSMQLWGSTSNDGAFPITNISGTSMGRYSCCYHPDWTSSIKIQPSNTLELLVTGLLPKPSLLAQPGPMVAPGENMTLQCQGELPDSTFVLLKEGAQEPLEQQRPSGYRADFWMPAVRGEDSGIYSCVYYLDSTPFAASNHSDSLEIWVTDKPPKPSLSAWPSTMFKLGKDITLQCRGPLPGVEFVLEHDGEEAPQQFSEDGDFVINNVEGKGIGNYSCSYRLQAYPDIWSEPSDPLELVGAAGPVAQECTVGNIVRSSLIVVVVVALGVVLAIEWKKWPRLRTRGSETDGRDQTIALEECNQEGEPGTPANSPSSTSQRISVELPVPI

SEQ ID NO: 12498 - protein, 364 aa, Homo sapiens; identical to SEQ ID NO: 2927

SEQ ID NO: 12499 - protein, 323 aa, Homo sapiens; identical to SEQ ID NO: 2508

SEQ ID NO: 12500 - protein, 225 aa, Homo sapiens
MDQQAIYAELNLPTDSGPESSSPSSLPRDVCQGSPWHQFALKLSCAGIILLVLVVTGLSVSVTSLIQKSSIEKCSVDIQQSRNKTTERPGLLNCPIYWQQLREKCLLFSHTVNPWNNSLADCSTKESSLLLIRDKDELIHTQNLIRDKAILFWIGLNFSLSEKNWKWINGSFLNSNDLEIRGDAKENSCISISQTSVYSEYCSTEIRWICQKELTPVRNKVYPDS

SEQ ID NO: 12501 - protein, 125 aa, Homo sapiens; identical to SEQ ID NO: 2496

SEQ ID NO: 12502 - protein, 181 aa, Homo sapiens; identical to SEQ ID NO: 2480

SEQ ID NO: 12503 - protein, 179 aa, Homo sapiens
MAVFKTTLWRLISGTLGIICLSLMATLGILLKNSFTKLSIEPAFTPGPNIELQKDSDCCSCQEKWVGYRCNCYFISSEQKTWNESRHLCASQKSSLLQLQNTDELDFMSSSQQFYWIGLSYSEEHTAWLWENGSALSQYLFPSFETFNTKNCIAYNPNGNALDESCEDKNRYICKQQLI

SEQ ID NO: 12504 - protein, 1366 aa, Homo sapiens
MLAVGPAMDRDYPQHEPPPAGSLLYSPPPLQSAMLHCPYWNTFSLPPYPAFSSDSRPFMSSASFLGSQPCPDTSYAPVATASSLPPKTCDFAQDSSYFEDFSNISIFSSSVDSLSDIVDTPDFLPADSLNQVSTIWDDNPAPSTHDKLFQLSRPFAGFEDFLPSHSTPLLVSYQEQSVQSQPEEEDEAEEEEAEELGHTETYADYVPSKSKIGKQHPDRVVETSTLSSVPPPDITYTLALPSDSGALSALQLEAITYACQQHEVLLPSGQRAGFLIGDGAGVGKGRTVAGVILENHLRGRKKALWFSVSNDLKYDAERDLRDIEATGIAVHALSKIKYGDTTTSEGVLFATYSALIGESQAGGQHRTRLRQILDWCGEAFEGVIVFDECHKAKNAGSTKMGKAVLDLQNKLPLARVVYASATGASEPRNMIYMSRLGIWGEGTPFRNFEEFLHAIEKRGVGAMEIVAMDMKVSGMYIARQLSFSGVTFRIEEIPLAPAFECVYNRAALLWAEALNVFQQAADWIGLESRKSLWGQFWSAHQRFFKYLCIAAKVRRLVELAREELARDKCVVIGLQSTGEARTREVLGENDGHLNCFVSAAEGVFLSLIQKHFPSTKRKRDRGAGSKRKRRPRGRGAKAPRLACETAGVIRISDDSSTESDPGLDSDFNSSPESLVDDDVVIVDAVGLPSDDRGSLCLLQRDPHGPGVLERVERLKQDLLDKVRRLGRELPVNTLDELIDQLGGPQRVAEMTGRKGRVVSRPDGTVAFESRAEQGLSIDHVNLREKQRFMSGEKLVAIISEASSSGVSLQADRRVQNQRRRVHMTLELPWSADRAIQQFGRTHRSNQVSAPEYVFLISELAGERRFASIVAKRLESLGALTHGDRRATESRDLSKYNFENKYGTRALHCVLTTILSQTENKVPVPQGYPGGVPTFFRDMKQGLLSVGIGGRESRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDAFAKSLALTGPYDGFYLSYKVRGNKPSCLLAEQNRGQFFTVYKPNIGRQSQLEALDSLRRKFHRVTAEEAKEPWESGYALSLTHCSHSAWNRHCRLAQEGKDCLQGLRLRHHYMLCGALLRVWGRIAAVMADVSSSSYLQIVRLKTKDRKKQVGIKIPEGCVRRVLQELRLMDADVKRRQAPALGCPAPPAPRPLALPCGPGEVLDLTYSPPAEAFPPPPHFSFPAPLSLDAGPGVVPLGTPDAQADPAALAHQGCDINFKEVLEDMLRSLHAGPPSEGALGEGAGAGGAAGGGPERQSVIQFSPPFPGAQAPL

SEQ ID NO: 12505 - protein, 362 aa, Homo sapiens; identical to SEQ ID NO: 2509

SEQ ID NO: 12506 - protein, 343 aa, Homo sapiens; identical to SEQ ID NO: 2511

SEQ ID NO: 12507 - protein, 686 aa, Homo sapiens
MQLGEQLLVSSVNLPGAHFYPLESARGGSGGSAGHLPSAAPSPQKLDLDKASKKFSGSLSCEAVSGEPAAASAGAPAAMLSDTDAGDAFASAAAVAKPGPPDGRKGSPCGEEELPSAAAAAAAAAAAAAATARYSMDSLSSERYYLQSPGPQGSELAAPCSLFPYQAAAGAPHGPVYPAPNGARYPYGSMLPPGGFPAAVCPPGRAQFGPGAGAGSGAGGSSGGGGGPGTYQYSQGAPLYGPYPGAAAAGSCGGLGGLGVPGSGFRAHVYLCNRPLWLKFHRHQTEMIITKQGRRMFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 12508 - protein, 114 aa, Homo sapiens
MRLLILALLGICSLTAYIVEGVGSEVSDKRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 12509 - protein, 389 aa, Homo sapiens
MEFPLAQICPQGSHEAPIPTFSTFQITDMTRRSCQNLGYTAASPQAPEAASSTGNAERAEEVPGEGSLFLQAETRAWFQKTQAHWLLQHGAAPAWFHGFITRREAERLLEPKPQGCYLVRFSESAVTFVLTYRSRTCCRHFLLAQLRDGRHVVLGEDSAHARLQDLLLHYTAHPLSPYGETLTEPLARQTPEPAGLSLRTEESNFGSKSQDPNPQYSPIIKQGQAPVPMQKEGAGEKEPSQLLRPKPPIPAKPQLPPEVYTIPVPRHRPAPRPKPSNPIYNEPDEPIAFYAMGRGSPGEAPSNIYVEVEDEGLPATLGHPVLRKSWSRPVPGGQNTGGSQLHSENSVIGQGPPLPHQPPPAWRHTLPHNLSRQVLQDRGQAWLPLGPPQ

SEQ ID NO: 12510 - protein, 1960 aa, Homo sapiens
MAQQAADKYLYVDKNFINNPLAQADWAAKKLVWVPSDKSGFEPASLKEEVGEEAIVELVENGKKVKVNKDDIQKMNPPKFSKVEDMAELTCLNEASVLHNLKERYYSGLIYTYSGLFCVVINPYKNLPIYSEEIVEMYKGKKRHEMPPHIYAITDTAYRSMMQDREDQSILCTGESGAGKTENTKKVIQYLAYVASSHKSKKDQGELERQLLQANPILEAFGNAKTVKNDNSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 12511 - protein, 206 aa, Homo sapiens; identical to SEQ ID NO: 2938

SEQ ID NO: 12512 - protein, 195 aa, Homo sapiens
MAAEDVVATGADPSDLESGGLLHEIFTSPLNLLLLGLCIFLLYKIVRGDQPAASGDSDDDEPPPLPRLKRRDFTPAELRRFDGVQDPRILMAINGKVFDVTKGRKFYGPEGPYGVFAGRDASRGLATFCLDKEALKDEYDDLSDLTAAQQETLSDWESQFTFKYHHVGKLLKEGEEPTVYSDEEEPKDESARKND

SEQ ID NO: 12513 - protein, 132 aa, Homo sapiens
MALLLTTVIALTCLGGFASPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFN

SEQ ID NO: 12514 - protein, 381 aa, Homo sapiens; identical to SEQ ID NO: 2513

SEQ ID NO: 12515 - protein, 381 aa, Homo sapiens
MPFGNTHNKFKLNYKPEEEYPDLSKHNNHMAKVLTLELYKKLRDKETPSGFTVDDVIQTGVDNPGHPFIMTVGCVAGDEESYEVFKELFDPIISDRHGGYKPTDKHKTDLNHENLKGGDDLDPNYVLSSRVRTGRSIKGYTLPPHCSRGERRAVEKLSVEALNSLTGEFKGKYYPLKSMTEKEQQQLIDDHFLFDKPVSPLLLASGMARDWPDARGIWHNDNKSFLVWVNEEDHLRVISMEKGGNMKEVFRRFCVGLQKIEEIFKKAGHPFMWNQHLGYVLTCPSNLGTGLRGGVHVKLAHLSKHPKFEEILTRLRLQKRGTGGVDTAAVGSVFDVSNADRLGSSEVEQVQLVVDGVKLMVEMEKKLEKGQSIDDMIPAQK

SEQ ID NO: 12516 - protein, 541 aa, Homo sapiens; identical to SEQ ID NO: 2514

SEQ ID NO: 12517 - protein, 288 aa, Homo sapiens; identical to SEQ ID NO: 2515

SEQ ID NO: 12518 - protein, 154 aa, Homo sapiens; identical to SEQ ID NO: 2516

SEQ ID NO: 12519 - DNA, 50 bp, Homo sapiens; identical to SEQ ID NO: 81

SEQ ID NO: 12520 - DNA, 50 bp, Homo sapiens
cgctgagaagacggtcgaacttgactatctagaggaagtaaaagtcgtaa

SEQ ID NO: 12521 - DNA, 50 bp, Homo sapiens
ctgggcttctcagaggtggagctggtgcagatggtggtggacggagtgaa

SEQ ID NO: 12522 - DNA, 50 bp, Homo sapiens
aagttggagaaaggccagtccattgacgacatgatccccgcccagaagta

SEQ ID NO: 12523 - DNA, 50 bp, Homo sapiens; identical to SEQ ID NO: 131

SEQ ID NO: 12524 - DNA, 50 bp, Homo sapiens; identical to SEQ ID NO: 1

SEQ ID NO: 12525 - DNA, 50 bp, Homo sapiens
aaccccaaatccaagccattaactacacctgacagtagcaattgtctgat

SEQ ID NO: 12526 - DNA, 20 bp, Homo sapiens
tcaatgcaggcgtccaagta

SEQ ID NO: 12527 - DNA, 25 bp, Homo sapiens
caaacatcactctgctgcttagaca

SEQ ID NO: 12528 - DNA, 21 bp, Homo sapiens
agcaccgtgtgggacaataac

SEQ ID NO: 12529 - DNA, 20 bp, Homo sapiens
gaagccaccccactcctgta

SEQ ID NO: 12530 - DNA, 20 bp, Homo sapiens
tagggcctggcttctgtctg

SEQ ID NO: 12531 - DNA, 24 bp, Homo sapiens
tgatactcccagtcttgtcattgc

SEQ ID NO: 12532 - DNA, 20 bp, Homo sapiens
tttgcgtgcagtgtctttcc

SEQ ID NO: 12533 - DNA, 20 bp, Homo sapiens
gaaccgctcctacagcaagc

SEQ ID NO: 12534 - DNA, 24 bp, Homo sapiens
ttcacagtgtgtggtcaacatttc

SEQ ID NO: 12535 - DNA, 21 bp, Homo sapiens
gccactccactctcttcaacg

SEQ ID NO: 12536 - DNA, 31 bp, Homo sapiens; identical to SEQ ID NO: 761

SEQ ID NO: 12537 - DNA, 20 bp, Homo sapiens
tcagctggctgggaggatta

SEQ ID NO: 12538 - DNA, 20 bp, Homo sapiens
accccactgtggctgatttg

SEQ ID NO: 12539 - DNA, 20 bp, Homo sapiens
actaggcgtcctcccgactc

SEQ ID NO: 12540 - DNA, 22 bp, Homo sapiens
tggcatgtcagacagaacttga

SEQ ID NO: 12541 - DNA, 24 bp, Homo sapiens
acgtgattttgctgtagaagatgg

SEQ ID NO: 12542 - DNA, 20 bp, Homo sapiens
tgcagatgagacagcaacca

SEQ ID NO: 12543 - DNA, 22 bp, Homo sapiens
ctcctcaagtccccaagattca

SEQ ID NO: 12544 - DNA, 22 bp, Homo sapiens
tgagtgctgtctccatgtttga

SEQ ID NO: 12545 - DNA, 22 bp, Homo sapiens
ggtataccctttgtgcctttgc

SEQ ID NO: 12546 - DNA, 24 bp, Homo sapiens
tcccacatgaaaaggtaattgtcc

SEQ ID NO: 12547 - DNA, 20 bp, Homo sapiens
ctgtggtgtgttccccatgt

SEQ ID NO: 12548 - DNA, 22 bp, Homo sapiens
cctgaccaaattgttttgtgga

SEQ ID NO: 12549 - DNA, 23 bp, Homo sapiens
caccttgcactcttaccgtcttg

SEQ ID NO: 12550 - DNA, 21 bp, Homo sapiens
ggggctactggagaggagaga

SEQ ID NO: 12551 - DNA, 21 bp, Homo sapiens
gcaactgctagcatcgacctc

SEQ ID NO: 12552 - DNA, 20 bp, Homo sapiens
ggcaaattctgcgagtgtga

SEQ ID NO: 12553 - DNA, 21 bp, Homo sapiens
cggagtaatccaggtcggttt

SEQ ID NO: 12554 - DNA, 20 bp, Homo sapiens
tcctttccaagctcctcgtg

SEQ ID NO: 12555 - DNA, 20 bp, Homo sapiens
ggcacatggaggtgatgatg

SEQ ID NO: 12556 - DNA, 20 bp, Homo sapiens
aggcctggggtagagcagac

SEQ ID NO: 12557 - DNA, 20 bp, Homo sapiens
ttcgatgggcccaattctta

SEQ ID NO: 12558 - DNA, 20 bp, Homo sapiens
aattgttggagagcccctca

SEQ ID NO: 12559 - DNA, 20 bp, Homo sapiens
ctcccttgtggcttcctcag

SEQ ID NO: 12560 - DNA, 20 bp, Homo sapiens
ctgagctctggctttgcctt

SEQ ID NO: 12561 - DNA, 25 bp, Homo sapiens
gattaattcaccttccagtgtctcg

SEQ ID NO: 12562 - DNA, 23 bp, Homo sapiens
ggaataggggaacatatcccaca

SEQ ID NO: 12563 - DNA, 20 bp, Homo sapiens
taccacctgcgtgtcccttc

SEQ ID NO: 12564 - DNA, 21 bp, Homo sapiens
aaacagaggccatggcagaat

SEQ ID NO: 12565 - DNA, 20 bp, Homo sapiens
ctggctcacctggacaacct

SEQ ID NO: 12566 - DNA, 20 bp, Homo sapiens
gactgtgctccggcagttct

SEQ ID NO: 12567 - DNA, 29 bp, Homo sapiens
ttcaaagttaaaagcaaacacttacagaa

SEQ ID NO: 12568 - DNA, 20 bp, Homo sapiens
ccagaatgctgcaggacttg

SEQ ID NO: 12569 - DNA, 23 bp, Homo sapiens
ctacctcaagggggactgtcttt

SEQ ID NO: 12570 - DNA, 20 bp, Homo sapiens
tgcgtcattacagggcacag

SEQ ID NO: 12571 - DNA, 25 bp, Homo sapiens
ctgcaagagtttcttggtgtaatga

SEQ ID NO: 12572 - DNA, 25 bp, Homo sapiens
ttttcagagtggaatgcttcctaga

SEQ ID NO: 12573 - DNA, 20 bp, Homo sapiens
cacaatgtggccgaggactt

SEQ ID NO: 12574 - DNA, 21 bp, Homo sapiens
ccttggaagatctgacccgaa

SEQ ID NO: 12575 - DNA, 18 bp, Homo sapiens
tccactgccatcctccca

SEQ ID NO: 12576 - DNA, 20 bp, Homo sapiens
ttcctcagttcctgcccttg

SEQ ID NO: 12577 - DNA, 20 bp, Homo sapiens
cacccttggaggctgtcttc

SEQ ID NO: 12578 - DNA, 20 bp, Homo sapiens
acagggagacccgtccattt

SEQ ID NO: 12579 - DNA, 20 bp, Homo sapiens
gttcggaccccaacaacaag

SEQ ID NO: 12580 - DNA, 22 bp, Homo sapiens
aaggcactaaggttgcaaaagc

SEQ ID NO: 12581 - DNA, 24 bp, Homo sapiens
ccttctccttttcttactctcccc

SEQ ID NO: 12582 - DNA, 20 bp, Homo sapiens
ctcttggcccctgtgtgagt

SEQ ID NO: 12583 - DNA, 20 bp, Homo sapiens
ccctgtctgtgggttcgtct

SEQ ID NO: 12584 - DNA, 22 bp, Homo sapiens
ccctctcttctccaatcaagca

SEQ ID NO: 12585 - DNA, 20 bp, Homo sapiens
gctgaccttcctcgcagaga

SEQ ID NO: 12586 - DNA, 24 bp, Homo sapiens
tgactgatctctgtggtttggttt

SEQ ID NO: 12587 - DNA, 19 bp, Homo sapiens
gcacgggctacaagctgag

SEQ ID NO: 12588 - DNA, 21 bp, Homo sapiens
gctgacccacacctgacactt

SEQ ID NO: 12589 - DNA, 20 bp, Homo sapiens
tttgggcagcttgggtaagt

SEQ ID NO: 12590 - DNA, 20 bp, Homo sapiens
gcaaccaggaaggcactgat

SEQ ID NO: 12591 - DNA, 20 bp, Homo sapiens
ccaccctccacaggaaattg

SEQ ID NO: 12592 - DNA, 24 bp, Homo sapiens
aaggtgttctagagccatttgcat

SEQ ID NO: 12593 - DNA, 20 bp, Homo sapiens
aacaaggccaaccatggaaa

SEQ ID NO: 12594 - DNA, 20 bp, Homo sapiens
ccagggtcagggaaaggact

SEQ ID NO: 12595 - DNA, 20 bp, Homo sapiens
accctctgtgtgggatggaa

SEQ ID NO: 12596 - DNA, 22 bp, Homo sapiens
tgccaaaatctcttctcccttc

SEQ ID NO: 12597 - DNA, 20 bp, Homo sapiens
aagccagaagccaggaggag

SEQ ID NO: 12598 - DNA, 20 bp, Homo sapiens
tctcgtggaacacaggcaaa

SEQ ID NO: 12599 - DNA, 20 bp, Homo sapiens
tccttcccctagcagcttcc

SEQ ID NO: 12600 - DNA, 22 bp, Homo sapiens
gcctgaatgtgccataagactg

SEQ ID NO: 12601 - DNA, 21 bp, Homo sapiens
ggccacaagaataagcagcaa

SEQ ID NO: 12602 - DNA, 20 bp, Homo sapiens
agtccagcctgagggctctt

SEQ ID NO: 12603 - DNA, 23 bp, Homo sapiens
agggacaatacagaacccattcc

SEQ ID NO: 12604 - DNA, 25 bp, Homo sapiens
tgccgtgttattgtattaggtgtca

SEQ ID NO: 12605 - DNA, 20 bp, Homo sapiens
acgagcctgcaccaaagtct

SEQ ID NO: 12606 - DNA, 24 bp, Homo sapiens
tgctgtactcaggtggcactaact

SEQ ID NO: 12607 - DNA, 22 bp, Homo sapiens
caccttggtggaacctggttag

SEQ ID NO: 12608 - DNA, 20 bp, Homo sapiens
tgtgtgtgcttgtgcgtgtc

SEQ ID NO: 12609 - DNA, 20 bp, Homo sapiens
agccgaggactggaagaagg

SEQ ID NO: 12610 - DNA, 22 bp, Homo sapiens
ctggtgggaggtctccataaac

SEQ ID NO: 12611 - DNA, 22 bp, Homo sapiens
cattcttcatcctcacccagga

SEQ ID NO: 12612 - DNA, 20 bp, Homo sapiens
agggcatcatctgggacatc

SEQ ID NO: 12613 - DNA, 20 bp, Homo sapiens
catcaccgtggtgaagcaag

SEQ ID NO: 12614 - DNA, 21 bp, Homo sapiens
cccctctcttcctacccttcc

SEQ ID NO: 12615 - DNA, 19 bp, Homo sapiens
ttcatcttccccaagtgcg

SEQ ID NO: 12616 - DNA, 20 bp, Homo sapiens
accagaccattgcccttgaa

SEQ ID NO: 12617 - DNA, 20 bp, Homo sapiens
ctccccgaaacaccagaaga

SEQ ID NO: 12618 - DNA, 21 bp, Homo sapiens
acctccttcgtcattgccata

SEQ ID NO: 12619 - DNA, 25 bp, Homo sapiens
cagctgtatttccatctcacagaca

SEQ ID NO: 12620 - DNA, 22 bp, Homo sapiens
tcccaaattgaatcactgctca

SEQ ID NO: 12621 - DNA, 24 bp, Homo sapiens
agtgattgacttggcatgaaaatg

SEQ ID NO: 12622 - DNA, 24 bp, Homo sapiens
gcgtataatccaaatggaaatgct

SEQ ID NO: 12623 - DNA, 20 bp, Homo sapiens
gccctctctgtgcctctcct

SEQ ID NO: 12624 - DNA, 20 bp, Homo sapiens
ggaggaacagacccaggaca

SEQ ID NO: 12625 - DNA, 20 bp, Homo sapiens
acgagtggagttgggtgtcg

SEQ ID NO: 12626 - DNA, 20 bp, Homo sapiens
cgacccagaccacacagaca

SEQ ID NO: 12627 - DNA, 20 bp, Homo sapiens
tgccacagtcctcacctcaa

SEQ ID NO: 12628 - DNA, 22 bp, Homo sapiens
tgaggctcctgaaactcacaaa

SEQ ID NO: 12629 - DNA, 20 bp, Homo sapiens
tgttgtgccagggaaggttt

SEQ ID NO: 12630 - DNA, 20 bp, Homo sapiens
agagcccgaggtcaaaaggt

SEQ ID NO: 12631 - DNA, 20 bp, Homo sapiens
ccaaagccactgggacactt

SEQ ID NO: 12632 - DNA, 20 bp, Homo sapiens
cggaggagattttcggacct

SEQ ID NO: 12633 - DNA, 21 bp, Homo sapiens
ccctccacatgaatcagcagt

SEQ ID NO: 12634 - DNA, 20 bp, Homo sapiens
ggcctgattgaggagatgga

SEQ ID NO: 12635 - DNA, 20 bp, Homo sapiens
cggctgctttttctagtggg

SEQ ID NO: 12636 - DNA, 20 bp, Homo sapiens
gtccaccacttgctgggttt

SEQ ID NO: 12637 - DNA, 20 bp, Homo sapiens
attgggtgcccagtgctatc

SEQ ID NO: 12638 - DNA, 20 bp, Homo sapiens
agacgtggtcaggagcatgg

SEQ ID NO: 12639 - DNA, 19 bp, Homo sapiens
acctgtgaagcccaggagg

SEQ ID NO: 12640 - DNA, 19 bp, Homo sapiens
ctccgagttttggcgtgag

SEQ ID NO: 12641 - DNA, 20 bp, Homo sapiens
ggttgggcctggttgacttt

SEQ ID NO: 12642 - DNA, 23 bp, Homo sapiens
ttcaggaagtcaattgcagaagg

SEQ ID NO: 12643 - DNA, 29 bp, Homo sapiens
cacttcttttctagaggctcaaatacaat

SEQ ID NO: 12644 - DNA, 20 bp, Homo sapiens
cccacctaatgaagcgcaaa

SEQ ID NO: 12645 - DNA, 20 bp, Homo sapiens
gctcccactgtcctggtttc

SEQ ID NO: 12646 - DNA, 20 bp, Homo sapiens
tcaggtcccagttgctgtca

SEQ ID NO: 12647 - DNA, 20 bp, Homo sapiens
gtgcctctgcttcccaagat

SEQ ID NO: 12648 - DNA, 24 bp, Homo sapiens
gagctctccatgcatttggtattt

SEQ ID NO: 12649 - DNA, 21 bp, Homo sapiens
ggttcccattgtgagtgtgct

SEQ ID NO: 12650 - DNA, 22 bp, Homo sapiens
tttgggagttttgctgattcct

SEQ ID NO: 12651 - DNA, 20 bp, Homo sapiens
tggtggggcaatggttattt

SEQ ID NO: 12652 - DNA, 20 bp, Homo sapiens
ctgaggcagacagcagctca

SEQ ID NO: 12653 - DNA, 21 bp, Homo sapiens
gtaacccgttgaaccccattc

SEQ ID NO: 12654 - DNA, 20 bp, Homo sapiens
cctgggcaagcatgagaagt

SEQ ID NO: 12655 - DNA, 20 bp, Homo sapiens
ctgggctcgtccgaagtaga

SEQ ID NO: 12656 - DNA, 20 bp, Homo sapiens
tctcaggcccttgactttgg

SEQ ID NO: 12657 - DNA, 20 bp, Homo sapiens
gcagactgagcgggaaaaga

SEQ ID NO: 12658 - DNA, 20 bp, Homo sapiens
aaccccaaatccaagccatt

SEQ ID NO: 12659 - DNA, 20 bp, Homo sapiens
cccaacttcctgacggttca

SEQ ID NO: 12660 - DNA, 24 bp, Homo sapiens
tccaaggtctgatcatcttcttga

SEQ ID NO: 12661 - DNA, 20 bp, Homo sapiens
gagcacatccccaaaatcca

SEQ ID NO: 12662 - DNA, 20 bp, Homo sapiens
ttggggaaattcctgagctg

SEQ ID NO: 12663 - DNA, 20 bp, Homo sapiens
gttcattctgccccatcagc

SEQ ID NO: 12664 - DNA, 24 bp, Homo sapiens
gactgtggagttttggctgtttta

SEQ ID NO: 12665 - DNA, 19 bp, Homo sapiens
aggctccccatttcccttc

SEQ ID NO: 12666 - DNA, 20 bp, Homo sapiens
gccgcgttcatgtcgtaata

SEQ ID NO: 12667 - DNA, 21 bp, Homo sapiens
gcccctttgttctaagccaga

SEQ ID NO: 12668 - DNA, 22 bp, Homo sapiens
tcgatcttgggagccaagtagt

SEQ ID NO: 12669 - DNA, 28 bp, Homo sapiens
agaattgatttaggaaagtcacaaacct

SEQ ID NO: 12670 - DNA, 20 bp, Homo sapiens
tggacccaggggttatcaga

SEQ ID NO: 12671 - DNA, 20 bp, Homo sapiens
aagtggggaatgccaaatga

SEQ ID NO: 12672 - DNA, 20 bp, Homo sapiens
ctagcccctgctctgtgcat

SEQ ID NO: 12673 - DNA, 24 bp, Homo sapiens
gtcaacaatatttggaagcaccag

SEQ ID NO: 12674 - DNA, 21 bp, Homo sapiens
ggtgctgaaatcaacccactc

SEQ ID NO: 12675 - DNA, 25 bp, Homo sapiens
cctgatatgttttaagtgggaagca

SEQ ID NO: 12676 - DNA, 21 bp, Homo sapiens
caacattgctccagaggttgg

SEQ ID NO: 12677 - DNA, 21 bp, Homo sapiens
gaattctctgctccccacctc

SEQ ID NO: 12678 - DNA, 20 bp, Homo sapiens
gtcctgggctttctcccttg

SEQ ID NO: 12679 - DNA, 21 bp, Homo sapiens
gcctggaaataagcccaaaca

SEQ ID NO: 12680 - DNA, 20 bp, Homo sapiens
gtccccagggaacactggta

SEQ ID NO: 12681 - DNA, 21 bp, Homo sapiens
acgggtcccctgtatgagagt

SEQ ID NO: 12682 - DNA, 20 bp, Homo sapiens
tgcccaattgacttcctcct

SEQ ID NO: 12683 - DNA, 20 bp, Homo sapiens
gagaattccggaacctgtgg

SEQ ID NO: 12684 - DNA, 21 bp, Homo sapiens
ggcatatgaccttgtggcatt

SEQ ID NO: 12685 - DNA, 20 bp, Homo sapiens
tgcaaacaccatttcctcca

SEQ ID NO: 12686 - DNA, 19 bp, Homo sapiens
gggaaggcgctttgtgaag

SEQ ID NO: 12687 - DNA, 20 bp, Homo sapiens
gcatcagccctggctctaaa

SEQ ID NO: 12688 - DNA, 20 bp, Homo sapiens
tagggctggaaaacgctgaa

SEQ ID NO: 12689 - DNA, 20 bp, Homo sapiens
gtggccttccctagcaggat

SEQ ID NO: 12690 - DNA, 20 bp, Homo sapiens
aaccttcatgcaccccattc

SEQ ID NO: 12691 - DNA, 20 bp, Homo sapiens
agtgcatgtttgggacagca

SEQ ID NO: 12692 - DNA, 20 bp, Homo sapiens
tttaggcaaaggggagcaca

SEQ ID NO: 12693 - DNA, 20 bp, Homo sapiens
tgcagtgttcctcccttcct

SEQ ID NO: 12694 - DNA, 23 bp, Homo sapiens
gctttcaagaatgaagtggttgg

SEQ ID NO: 12695 - DNA, 20 bp, Homo sapiens
cctctccccacattgtgtcc

SEQ ID NO: 12696 - DNA, 21 bp, Homo sapiens
gaggcacttgttctgctgctg

SEQ ID NO: 12697 - DNA, 20 bp, Homo sapiens
ctgcctgggacctcattcat

SEQ ID NO: 12698 - DNA, 20 bp, Homo sapiens
gcccaggagcctgaagttct

SEQ ID NO: 12699 - DNA, 20 bp, Homo sapiens
gatcagctgcttgtgcctgt

SEQ ID NO: 12700 - DNA, 25 bp, Homo sapiens
ttgatgatgtctctcactctgttcc

SEQ ID NO: 12701 - DNA, 21 bp, Homo sapiens
catctggagagaggaaggcct

SEQ ID NO: 12702 - DNA, 21 bp, Homo sapiens
ttggcctctttcagcctcttt

SEQ ID NO: 12703 - DNA, 23 bp, Homo sapiens
tgcaaaataggaaggcaatagca

SEQ ID NO: 12704 - DNA, 21 bp, Homo sapiens
tccaaaatctttggctgcaac

SEQ ID NO: 12705 - DNA, 22 bp, Homo sapiens
ctggagcattcagtttccattg

SEQ ID NO: 12706 - DNA, 20 bp, Homo sapiens
tggcttttaggatggcaagg

SEQ ID NO: 12707 - DNA, 21 bp, Homo sapiens
ggccagaatttccttctccac

SEQ ID NO: 12708 - DNA, 30 bp, Homo sapiens; identical to SEQ ID NO: 1104

SEQ ID NO: 12709 - DNA, 20 bp, Homo sapiens
gatgcacaggaggccatagg

SEQ ID NO: 12710 - DNA, 20 bp, Homo sapiens
tgggagagggtgtggagcta

SEQ ID NO: 12711 - DNA, 19 bp, Homo sapiens
agatgatccccgcacatga

SEQ ID NO: 12712 - DNA, 20 bp, Homo sapiens
ccgggagacagtcaggagtc

SEQ ID NO: 12713 - DNA, 21 bp, Homo sapiens
tgccatccatccacttattcc

SEQ ID NO: 12714 - DNA, 20 bp, Homo sapiens
cgcctatattgcatggcctc

SEQ ID NO: 12715 - DNA, 20 bp, Homo sapiens
ctcaattcgtcctggcaacc

SEQ ID NO: 12716 - DNA, 20 bp, Homo sapiens
cacacgcaacatgacacacc

SEQ ID NO: 12717 - DNA, 22 bp, Homo sapiens
agaaaaccagtgttggcatgaa

SEQ ID NO: 12718 - DNA, 20 bp, Homo sapiens
ccaaaggaagccctcagaga

SEQ ID NO: 12719 - DNA, 19 bp, Homo sapiens
aggcaggaagcccattttg

SEQ ID NO: 12720 - DNA, 19 bp, Homo sapiens
cctgcagtgggccctagtc

SEQ ID NO: 12721 - DNA, 20 bp, Homo sapiens
aggtggcttcacccttttcc

SEQ ID NO: 12722 - DNA, 27 bp, Homo sapiens
aatttctggaaaagtcaacaggataca

SEQ ID NO: 12723 - DNA, 20 bp, Homo sapiens
ttgagaggcaaatggggtct

SEQ ID NO: 12724 - DNA, 20 bp, Homo sapiens
tgggtggaggacccattaaa

SEQ ID NO: 12725 - DNA, 30 bp, Homo sapiens
gtgcaatacacttttattttccttttacct

SEQ ID NO: 12726 - DNA, 20 bp, Homo sapiens
cctggcactactggcacctt

SEQ ID NO: 12727 - DNA, 20 bp, Homo sapiens
cctttccagccccttttctc

SEQ ID NO: 12728 - DNA, 20 bp, Homo sapiens
caggacctggatgcactgaa

SEQ ID NO: 12729 - DNA, 25 bp, Homo sapiens
tgatcacatgaagtcacattggttt

SEQ ID NO: 12730 - DNA, 21 bp, Homo sapiens
gggaccgctttcttacctgtt

SEQ ID NO: 12731 - DNA, 20 bp, Homo sapiens
tgctttgcagggctgagtta

SEQ ID NO: 12732 - DNA, 20 bp, Homo sapiens
tggagcaggggtggtttcta

SEQ ID NO: 12733 - DNA, 21 bp, Homo sapiens
cccacagtgcttgacacagaa

SEQ ID NO: 12734 - DNA, 23 bp, Homo sapiens
accaaaatgagaacctcaacagc

SEQ ID NO: 12735 - DNA, 20 bp, Homo sapiens
gcccagtggacaggtttctg

SEQ ID NO: 12736 - DNA, 20 bp, Homo sapiens
gagcttccctcatggggtgt

SEQ ID NO: 12737 - DNA, 23 bp, Homo sapiens
ccatgtatttgcaacagcagaga

SEQ ID NO: 12738 - DNA, 20 bp, Homo sapiens
tcattacagcgggggcttag

SEQ ID NO: 12739 - DNA, 23 bp, Homo sapiens
cagtcattggtgtctttggagtg

SEQ ID NO: 12740 - DNA, 23 bp, Homo sapiens
caaaagcaatgtggaagaaacca

SEQ ID NO: 12741 - DNA, 20 bp, Homo sapiens
ccggccacattcactgattt

SEQ ID NO: 12742 - DNA, 20 bp, Homo sapiens
aagcggtcgatggtcttctg

SEQ ID NO: 12743 - DNA, 23 bp, Homo sapiens
agttcaacccaaatgatcaggaa

SEQ ID NO: 12744 - DNA, 20 bp, Homo sapiens
tggggttggagctcaatctt

SEQ ID NO: 12745 - DNA, 20 bp, Homo sapiens
tgagcactgccatcaagctc

SEQ ID NO: 12746 - DNA, 20 bp, Homo sapiens
caaggggtccacagaccagt

SEQ ID NO: 12747 - DNA, 20 bp, Homo sapiens
tcctggaagaggcaggcttt

SEQ ID NO: 12748 - DNA, 18 bp, Homo sapiens
cctgggctgtggcttcat

SEQ ID NO: 12749 - DNA, 20 bp, Homo sapiens
cgggcagttccacagagatt

SEQ ID NO: 12750 - DNA, 20 bp, Homo sapiens
gcagctcctcatccatctcc

SEQ ID NO: 12751 - DNA, 20 bp, Homo sapiens
aagagggccatgcattggta

SEQ ID NO: 12752 - DNA, 29 bp, Homo sapiens
tcaagagtcaggatacactttatttctca

SEQ ID NO: 12753 - DNA, 20 bp, Homo sapiens
gatctccaccggacagcact

SEQ ID NO: 12754 - DNA, 20 bp, Homo sapiens
ctgtggtgctcttggtctgc

SEQ ID NO: 12755 - DNA, 24 bp, Homo sapiens
tgttgggtctttactctccacctt

SEQ ID NO: 12756 - DNA, 20 bp, Homo sapiens
cacggatttcaagggtttgg

SEQ ID NO: 12757 - DNA, 20 bp, Homo sapiens
tcctctccagaaggcaccac

SEQ ID NO: 12758 - DNA, 20 bp, Homo sapiens
ttgagtggctgggactccat

SEQ ID NO: 12759 - DNA, 20 bp, Homo sapiens
agacgctgaagccatgatga

SEQ ID NO: 12760 - DNA, 20 bp, Homo sapiens
tcatttcccgtcttcgttgg

SEQ ID NO: 12761 - DNA, 20 bp, Homo sapiens
ccacgtgagccactcagaaa

SEQ ID NO: 12762 - DNA, 20 bp, Homo sapiens
tgacctcagacgtggagcag

SEQ ID NO: 12763 - DNA, 20 bp, Homo sapiens
agagcccgaggtcaaaaggt

SEQ ID NO: 12764 - DNA, 20 bp, Homo sapiens
ctcctgggtctcctgggttt

SEQ ID NO: 12765 - DNA, 20 bp, Homo sapiens
ggagcaggggtagagccact

SEQ ID NO: 12766 - DNA, 26 bp, Homo sapiens
tgatccatttaggtcagctttagtca

SEQ ID NO: 12767 - DNA, 20 bp, Homo sapiens
gccaggtcaaggtgggtcta

SEQ ID NO: 12768 - DNA, 20 bp, Homo sapiens
gcttcgggcccttacatctt

SEQ ID NO: 12769 - DNA, 20 bp, Homo sapiens
gccaaacctgcaaacaaaca

SEQ ID NO: 12770 - DNA, 20 bp, Homo sapiens
gaaggcacagccctctttca

SEQ ID NO: 12771 - DNA, 20 bp, Homo sapiens
gattgctgggttcctgttgg

SEQ ID NO: 12772 - DNA, 20 bp, Homo sapiens
agccatttcacaaacgcaca

SEQ ID NO: 12773 - DNA, 20 bp, Homo sapiens
cgccccaattaaggtggttt

SEQ ID NO: 12774 - DNA, 20 bp, Homo sapiens
cgtctagaccggcaaacaca

SEQ ID NO: 12775 - DNA, 20 bp, Homo sapiens
cattggccgcttttcagaat

SEQ ID NO: 12776 - DNA, 23 bp, Homo sapiens
ttcttgaactttccttggcaaaa

SEQ ID NO: 12777 - DNA, 20 bp, Homo sapiens
ggcctctctggaaagggtgt

SEQ ID NO: 12778 - DNA, 20 bp, Homo sapiens
caacagcagcattggaccag

SEQ ID NO: 12779 - DNA, 21 bp, Homo sapiens
gtgacagctgcaacacatgct

SEQ ID NO: 12780 - DNA, 20 bp, Homo sapiens
ttgggaactggtaggggtga

SEQ ID NO: 12781 - DNA, 19 bp, Homo sapiens
gacatagggtgctccggct

SEQ ID NO: 12782 - DNA, 23 bp, Homo sapiens
gggaggtctgaagtcgagtttgt

SEQ ID NO: 12783 - DNA, 20 bp, Homo sapiens
tttggggtgttgagggagtc

SEQ ID NO: 12784 - DNA, 19 bp, Homo sapiens
ctcgtggttcaggggtgtg

SEQ ID NO: 12785 - DNA, 20 bp, Homo sapiens
cagccacagtcttccccaat

SEQ ID NO: 12786 - DNA, 20 bp, Homo sapiens
gcaagcttatgacccgcact

SEQ ID NO: 12787 - DNA, 20 bp, Homo sapiens
cgttggagacgtcgaagacc

SEQ ID NO: 12788 - DNA, 20 bp, Homo sapiens
tggactggcctttctccaac

SEQ ID NO: 12789 - DNA, 20 bp, Homo sapiens
ttgaaccatctgggtgctga

SEQ ID NO: 12790 - DNA, 20 bp, Homo sapiens
cacagctccttggccttctc

SEQ ID NO: 12791 - DNA, 20 bp, Homo sapiens
cagcccagatctcctcctca

SEQ ID NO: 12792 - DNA, 32 bp, Homo sapiens; identical to SEQ ID NO: 1421

SEQ ID NO: 12793 - DNA, 31 bp, Homo sapiens; identical to SEQ ID NO: 1437

SEQ ID NO: 12794 - DNA, 22 bp, Homo sapiens
aaccccatctggtcagtgcggc

SEQ ID NO: 12795 - DNA, 29 bp, Homo sapiens
gcagaccagtggagtctcagaattggctc

SEQ ID NO: 12796 - DNA, 26 bp, Homo sapiens
caaggcaccacacaacccagaaagga

SEQ ID NO: 12797 - DNA, 32 bp, Homo sapiens; identical to SEQ ID NO: 1401

SEQ ID NO: 12798 - DNA, 34 bp, Homo sapiens
tggataatgcatttgatttatcagtgaagatgca

SEQ ID NO: 12799 - DNA, 20 bp, Homo sapiens
accctgtccgggctgatgcg

SEQ ID NO: 12800 - DNA, 34 bp, Homo sapiens; identical to SEQ ID NO: 1446

SEQ ID NO: 12801 - DNA, 33 bp, Homo sapiens
caaggggtacatctgcagacatactgagtgtca

SEQ ID NO: 12802 - DNA, 29 bp, Homo sapiens
tggaaaatgtgcaatatgtgatgtggcaa

SEQ ID NO: 12803 - DNA, 34 bp, Homo sapiens
tccagaagactcagacctcaaaatacagaggtgc

SEQ ID NO: 12804 - DNA, 22 bp, Homo sapiens
ggggtgcttacatgggggcaca

SEQ ID NO: 12805 - DNA, 21 bp, Homo sapiens
ccccaggggtgcaaggatgga

SEQ ID NO: 12806 - DNA, 31 bp, Homo sapiens; identical to SEQ ID NO: 1439

SEQ ID NO: 12807 - DNA, 31 bp, Homo sapiens; identical to SEQ ID NO: 1422

SEQ ID NO: 12808 - DNA, 33 bp, Homo sapiens; identical to SEQ ID NO: 1426

SEQ ID NO: 12809 - DNA, 30 bp, Homo sapiens
cctgactctgaaatctgaagacctcgagca

SEQ ID NO: 12810 - DNA, 27 bp, Homo sapiens
tccacaggtagctctaggagggctggc

SEQ ID NO: 12811 - DNA, 31 bp, Homo sapiens
tcacctgatgggaagttcttcgtttttcaaa

SEQ ID NO: 12812 - DNA, 31 bp, Homo sapiens
gcagtgccacttctgtcacatacagtaccca

SEQ ID NO: 12813 - DNA, 29 bp, Homo sapiens
ggtgaaaatggttcctggagtcaccagtg

SEQ ID NO: 12814 - DNA, 27 bp, Homo sapiens
tggcattcggtaattttgccttctgga

SEQ ID NO: 12815 - DNA, 24 bp, Homo sapiens
ggtgaatgtctgaggcctgcctcc

SEQ ID NO: 12816 - DNA, 31 bp, Homo sapiens; identical to SEQ ID NO: 1420

SEQ ID NO: 12817 - DNA, 30 bp, Homo sapiens
tgcttagcctcaggacatatgctcaggaga

SEQ ID NO: 12818 - DNA, 31 bp, Homo sapiens
caaattaagccattggatctatcacagttga

SEQ ID NO: 12819 - DNA, 32 bp, Homo sapiens
tcaaattcctccctgtacgaaaggacaagaga

SEQ ID NO: 12820 - DNA, 33 bp, Homo sapiens
caaatcctgtgtttgtactccaggaagtctgca

SEQ ID NO: 12821 - DNA, 33 bp, Homo sapiens
ttcactgaggtcaaggattgtaatattgccagc

SEQ ID NO: 12822 - DNA, 23 bp, Homo sapiens
tggtggcagacaggaccccttgc

SEQ ID NO: 12823 - DNA, 24 bp, Homo sapiens
tgccatggacagaagaaggcagca

SEQ ID NO: 12824 - DNA, 24 bp, Homo sapiens
cacagccctggcctctgctcaact

SEQ ID NO: 12825 - DNA, 22 bp, Homo sapiens
gcccttggcctgaagtcccagc

SEQ ID NO: 12826 - DNA, 26 bp, Homo sapiens
tgcaagggctctgtgacaaggaagga

SEQ ID NO: 12827 - DNA, 26 bp, Homo sapiens
gggattcccctaacctcattccccaa

SEQ ID NO: 12828 - DNA, 20 bp, Homo sapiens
agcagcgggtgaccccaccc

SEQ ID NO: 12829 - DNA, 22 bp, Homo sapiens
tccccgagtcagggcgacttcc

SEQ ID NO: 12830 - DNA, 20 bp, Homo sapiens
tcatgggtttggctgccccg

SEQ ID NO: 12831 - DNA, 24 bp, Homo sapiens
tgcactgtgacaagctgcacgtgg

SEQ ID NO: 12832 - DNA, 20 bp, Homo sapiens
cgctgcctgggtgcgactgc

SEQ ID NO: 12833 - DNA, 34 bp, Homo sapiens; identical to SEQ ID NO: 1415

SEQ ID NO: 12834 - DNA, 33 bp, Homo sapiens
agacctcacctagaaattgacacaagtggacct

SEQ ID NO: 12835 - DNA, 29 bp, Homo sapiens
ccatcccttaaatcctcaggtcacaacca

SEQ ID NO: 12836 - DNA, 25 bp, Homo sapiens
gccatggatggaaaacgctctctgc

SEQ ID NO: 12837 - DNA, 38 bp, Homo sapiens
caccgagtggataatagaaagttgagactaaactggtt

SEQ ID NO: 12838 - DNA, 26 bp, Homo sapiens
gcaccatggtcaaaacggattagggc

SEQ ID NO: 12839 - DNA, 32 bp, Homo sapiens; identical to SEQ ID NO: 1328

SEQ ID NO: 12840 - DNA, 22 bp, Homo sapiens
ccggctcgaggacgtggaggat

SEQ ID NO: 12841 - DNA, 20 bp, Homo sapiens
cccaaattctttcagtggct

SEQ ID NO: 12842 - DNA, 21 bp, Homo sapiens
gcgctgccatcaatgctggga

SEQ ID NO: 12843 - DNA, 24 bp, Homo sapiens
tcaggctctgccctgccctagctc

SEQ ID NO: 12844 - DNA, 21 bp, Homo sapiens
tggcaggggtggctgcctcat

SEQ ID NO: 12845 - DNA, 26 bp, Homo sapiens
tggggtgaggaggcttcaagacctct

SEQ ID NO: 12846 - DNA, 24 bp, Homo sapiens
tggcaggcacttaggatcctggca

SEQ ID NO: 12847 - DNA, 29 bp, Homo sapiens
tggtgttcccctcttaaaggaggaggagc

SEQ ID NO: 12848 - DNA, 32 bp, Homo sapiens
tcactgcccctacttagcagtctcagagagga

SEQ ID NO: 12849 - DNA, 20 bp, Homo sapiens
gcttgggctccaggccctgg

SEQ ID NO: 12850 - DNA, 32 bp, Homo sapiens
tgcaagtggaaaatacatctgtagagggacga

SEQ ID NO: 12851 - DNA, 25 bp, Homo sapiens
caagcctcattcccaacctgcacct

SEQ ID NO: 12852 - DNA, 23 bp, Homo sapiens
cgggatagggcaccaggaggtga

SEQ ID NO: 12853 - DNA, 22 bp, Homo sapiens
tcccttcaccttcgctgccaca

SEQ ID NO: 12854 - DNA, 23 bp, Homo sapiens
gagggagcaggcagcagactggc

SEQ ID NO: 12855 - DNA, 26 bp, Homo sapiens
ccaccaaagaactgtcagcagctgcc

SEQ ID NO: 12856 - DNA, 22 bp, Homo sapiens
tgggggatcctgtcctgcagca

SEQ ID NO: 12857 - DNA, 20 bp, Homo sapiens
tcatgggcagggccacagca

SEQ ID NO: 12858 - DNA, 35 bp, Homo sapiens
ttgtttacacaacgattactcgaagatgactgcaa

SEQ ID NO: 12859 - DNA, 27 bp, Homo sapiens
gcacactctcctgctcccaggatagga

SEQ ID NO: 12860 - DNA, 20 bp, Homo sapiens
agctggcctgggctccccct

SEQ ID NO: 12861 - DNA, 24 bp, Homo sapiens
cagccagacatttaggcgggagca

SEQ ID NO: 12862 - DNA, 27 bp, Homo sapiens
ccctccatcatcgacactggtctagcc

SEQ ID NO: 12863 - DNA, 32 bp, Homo sapiens; identical to SEQ ID NO: 1432

SEQ ID NO: 12864 - DNA, 24 bp, Homo sapiens
gcaccaaaatcacgggtttgcctg

SEQ ID NO: 12865 - DNA, 20 bp, Homo sapiens
ggggaccactgggcccctca

SEQ ID NO: 12866 - DNA, 28 bp, Homo sapiens
acgaagcatccacagatccctcaaaaca

SEQ ID NO: 12867 - DNA, 28 bp, Homo sapiens
tcctctttggccacaagaataagcagca

SEQ ID NO: 12868 - DNA, 22 bp, Homo sapiens
cggcaaatgtagcatgggcacc

SEQ ID NO: 12869 - DNA, 29 bp, Homo sapiens
tctttctacagggctgacattgtggcaca

SEQ ID NO: 12870 - DNA, 25 bp, Homo sapiens
cccctatggggatggtccactgtca

SEQ ID NO: 12871 - DNA, 31 bp, Homo sapiens; identical to SEQ ID NO: 1402

SEQ ID NO: 12872 - DNA, 27 bp, Homo sapiens
catctgcagccagttagtgccacctga

SEQ ID NO: 12873 - DNA, 39 bp, Homo sapiens
atttttctcagacctctaacttgctaccttcttgtagaa

SEQ ID NO: 12874 - DNA, 24 bp, Homo sapiens
aaaacagctggagagtcccagccg

SEQ ID NO: 12875 - DNA, 20 bp, Homo sapiens
acattgacatgggtgggttt

SEQ ID NO: 12876 - DNA, 32 bp, Homo sapiens; identical to SEQ ID NO: 1411

SEQ ID NO: 12877 - DNA, 29 bp, Homo sapiens
tcctgtacctgctcccaatctgtgttcct

SEQ ID NO: 12878 - DNA, 22 bp, Homo sapiens
tcccagctccactccccactgg

SEQ ID NO: 12879 - DNA, 21 bp, Homo sapiens
cccagccaaggaaccagccca

SEQ ID NO: 12880 - DNA, 27 bp, Homo sapiens
tcaccacttccctcagtcccaactcct

SEQ ID NO: 12881 - DNA, 24 bp, Homo sapiens
caaggcatggcgtagagggtgctg

SEQ ID NO: 12882 - DNA, 22 bp, Homo sapiens
ggcaggggtgcctggttctcct

SEQ ID NO: 12883 - DNA, 21 bp, Homo sapiens
ggggcggcacctgaacagctt

SEQ ID NO: 12884 - DNA, 27 bp, Homo sapiens
cacgccgcaatacagagactcagtcca

SEQ ID NO: 12885 - DNA, 33 bp, Homo sapiens
tcagatggatctgccaaaaagaactaacacctg

SEQ ID NO: 12886 - DNA, 28 bp, Homo sapiens
gctgatgatttagagtgctgtccggtgg

SEQ ID NO: 12887 - DNA, 28 bp, Homo sapiens
tccatacagcactgctggaggaagagga

SEQ ID NO: 12888 - DNA, 31 bp, Homo sapiens
gcaacagctcatttaaatgtttcttggggca

SEQ ID NO: 12889 - DNA, 20 bp, Homo sapiens
gccacccggagccccttcct

SEQ ID NO: 12890 - DNA, 20 bp, Homo sapiens
tccatcccctgcaggcctgg

SEQ ID NO: 12891 - DNA, 26 bp, Homo sapiens
caaaggcaattcccacaaaagctggc

SEQ ID NO: 12892 - DNA, 31 bp, Homo sapiens
ttgtgcttgctctccttccagttgtttatcc

SEQ ID NO: 12893 - DNA, 23 bp, Homo sapiens
tggctttggctgccacaatgtcc

SEQ ID NO: 12894 - DNA, 24 bp, Homo sapiens
ggaaaagaatggagccccttgggg

SEQ ID NO: 12895 - DNA, 28 bp, Homo sapiens
tcccgtgggatactatttcagacgtgca

SEQ ID NO: 12896 - DNA, 20 bp, Homo sapiens
cccgggtggaggagcccagt

SEQ ID NO: 12897 - DNA, 21 bp, Homo sapiens
tgggggtggcaggtctcctgg

SEQ ID NO: 12898 - DNA, 20 bp, Homo sapiens
cccggatgaacgccgctcct

SEQ ID NO: 12899 - DNA, 36 bp, Homo sapiens
catacaaaagctttcatgggttctagaaccttctta

SEQ ID NO: 12900 - DNA, 31 bp, Homo sapiens
caaggtgttgtggtcttccatccagtttctt

SEQ ID NO: 12901 - DNA, 22 bp, Homo sapiens
ggaggcggggtgtctgggaagt

SEQ ID NO: 12902 - DNA, 32 bp, Homo sapiens; identical to SEQ ID NO: 1431

SEQ ID NO: 12903 - DNA, 34 bp, Homo sapiens
gcaaaacaccttaacactcggcttctatttgctt

SEQ ID NO: 12904 - DNA, 31 bp, Homo sapiens
tccaacaccagaaataacatgatccagacca

SEQ ID NO: 12905 - DNA, 22 bp, Homo sapiens
caaagctgtgccctgggcatgg

SEQ ID NO: 12906 - DNA, 22 bp, Homo sapiens
acttgctggcctccggcatgtg

SEQ ID NO: 12907 - DNA, 28 bp, Homo sapiens
ggtggccaactgatcactgtaggagctg

SEQ ID NO: 12908 - DNA, 36 bp, Homo sapiens
agacaggatttggtaaaacagaatcaacttggttaa

SEQ ID NO: 12909 - DNA, 40 bp, Homo sapiens
catatttttaaaaacatgctttgagagtgattatttcctt

SEQ ID NO: 12910 - DNA, 20 bp, Homo sapiens
cgctccccctcgaccccctc

SEQ ID NO: 12911 - DNA, 26 bp, Homo sapiens
tggccctctgagccttttgagtctgg

SEQ ID NO: 12912 - DNA, 26 bp, Homo sapiens
gggggtagggtgggtgttttcactca

SEQ ID NO: 12913 - DNA, 20 bp, Homo sapiens
tggactggacccccagccca

SEQ ID NO: 12914 - DNA, 23 bp, Homo sapiens
cacgcgatagcattgcgagacgc

SEQ ID NO: 12915 - DNA, 22 bp, Homo sapiens
agccccggagaagctgtcagcc

SEQ ID NO: 12916 - DNA, 35 bp, Homo sapiens
tccagaaaggattgatatctgtgaattgtcctgaa

SEQ ID NO: 12917 - DNA, 29 bp, Homo sapiens
cagggtttgctctcctaagagccttcatg

SEQ ID NO: 12918 - DNA, 24 bp, Homo sapiens
ccccaacggtgacaaacacactca

SEQ ID NO: 12919 - DNA, 21 bp, Homo sapiens
tgatggggatcggggattgca

SEQ ID NO: 12920 - DNA, 20 bp, Homo sapiens
tccacaccgcctgtgcctcg

SEQ ID NO: 12921 - DNA, 23 bp, Homo sapiens
cacaccatccaccaccagctgca

SEQ ID NO: 12922 - DNA, 21 bp, Homo sapiens
tcagccacagggtgcctggga

SEQ ID NO: 12923 - DNA, 23 bp, Homo sapiens
tcaggtggtcaatggccagcacc

SEQ ID NO: 12924 - DNA, 25 bp, Homo sapiens
tctgctgtcttcaaggggccagtga

SEQ ID NO: 12925 - DNA, 20 bp, Homo sapiens
ccctgacatccaacccactc

SEQ ID NO: 12926 - DNA, 20 bp, Homo sapiens
tccgagaagtcaggcacgta

SEQ ID NO: 12927 - DNA, 20 bp, Homo sapiens
aggcaggggaatgtatgtgc

SEQ ID NO: 12928 - DNA, 20 bp, Homo sapiens
gctcccaagatcgaggatga

SEQ ID NO: 12929 - DNA, 20 bp, Homo sapiens
tcccaggggccataatctct

SEQ ID NO: 12930 - DNA, 20 bp, Homo sapiens
ccgagcccttcctagtggat

SEQ ID NO: 12931 - DNA, 25 bp, Homo sapiens
gctttaatggcatgtcagacagaac

SEQ ID NO: 12932 - DNA, 20 bp, Homo sapiens
gagcaggttgctccacaggt

SEQ ID NO: 12933 - DNA, 22 bp, Homo sapiens
cctttgtgcctttgcattatca

SEQ ID NO: 12934 - DNA, 20 bp, Homo sapiens
gcacaaaatcagccaaagca

SEQ ID NO: 12935 - DNA, 23 bp, Homo sapiens
tgaaacattggggtttcttcaaa

SEQ ID NO: 12936 - DNA, 20 bp, Homo sapiens
agggagaaccactgcacaca

SEQ ID NO: 12937 - DNA, 20 bp, Homo sapiens
agccaccccaagtgtggtta

SEQ ID NO: 12938 - DNA, 20 bp, Homo sapiens
gacccaggatagggccaaac

SEQ ID NO: 12939 - DNA, 21 bp, Homo sapiens
agtcccagcattgatgacagc

SEQ ID NO: 12940 - DNA, 22 bp, Homo sapiens
aaaaggtccggaggaggaatta

SEQ ID NO: 12941 - DNA, 20 bp, Homo sapiens
tatcctgggggacccaatgt

SEQ ID NO: 12942 - DNA, 20 bp, Homo sapiens
ccgcctggctgttattcttc

SEQ ID NO: 12943 - DNA, 20 bp, Homo sapiens
gcttctctgcagcacatcca

SEQ ID NO: 12944 - DNA, 20 bp, Homo sapiens
atggttgccaggacgaattg

SEQ ID NO: 12945 - DNA, 20 bp, Homo sapiens
cccaggatccaaatgtggtg

SEQ ID NO: 12946 - DNA, 20 bp, Homo sapiens
tgatcactggattgggctga

SEQ ID NO: 12947 - DNA, 20 bp, Homo sapiens
tcctgccttgtgagatgtgg

SEQ ID NO: 12948 - DNA, 20 bp, Homo sapiens
cccgcagctctgagtaagga

SEQ ID NO: 12949 - DNA, 35 bp, Homo sapiens
tcttcattcattgttcaggttatggtaaatgtttt

SEQ ID NO: 12950 - DNA, 20 bp, Homo sapiens
cgctccccctcgaccccctc

SEQ ID NO: 12951 - DNA, 35 bp, Homo sapiens
ggcatatgcagcttttatatcacttcatgatttga

SEQ ID NO: 12952 - DNA, 22 bp, Homo sapiens
agcattgcgagacgctggagcc

SEQ ID NO: 12953 - DNA, 23 bp, Homo sapiens
tggggtgttgagggagtcagggg

SEQ ID NO: 12954 - DNA, 20 bp, Homo sapiens
cccaggcggtcagcgttgga

SEQ ID NO: 12955 - DNA, 25 bp, Homo sapiens
tggagcccattggttggaactctgg

SEQ ID NO: 12956 - DNA, 20 bp, Homo sapiens
gcctgggaacaagggggcca

SEQ ID NO: 12957 - DNA, 23 bp, Homo sapiens
cccgctcagtctgcctcttccca

SEQ ID NO: 12958 - DNA, 20 bp, Homo sapiens
atgcttccccagctggcccg

SEQ ID NO: 12959 - DNA, 22 bp, Homo sapiens
caccaaggtggtggataagtca

SEQ ID NO: 12960 - DNA, 20 bp, Homo sapiens
gcagcctcctctgtgactcc

SEQ ID NO: 12961 - DNA, 20 bp, Homo sapiens
ccacttccctcagtcccaac

SEQ ID NO: 12962 - DNA, 20 bp, Homo sapiens
aagtcagccccatctgctgt

SEQ ID NO: 12963 - DNA, 20 bp, Homo sapiens
ttgcggcgtgtataccaatg

SEQ ID NO: 12964 - DNA, 30 bp, Homo sapiens
agaaattagaggtgatgctaaagaaaacag

SEQ ID NO: 12965 - DNA, 20 bp, Homo sapiens
ggggcagacccctgctaata

SEQ ID NO: 12966 - DNA, 20 bp, Homo sapiens
ggctctggggtgtctctcac

SEQ ID NO: 12967 - DNA, 20 bp, Homo sapiens
tcatcatggcttcagcgtct

SEQ ID NO: 12968 - DNA, 20 bp, Homo sapiens
tgcaaagggtggacatttca

SEQ ID NO: 12969 - DNA, 20 bp, Homo sapiens
gtatcccacgggagatgctg

SEQ ID NO: 12970 - DNA, 20 bp, Homo sapiens
accttttgacctcgggctct

SEQ ID NO: 12971 - DNA, 20 bp, Homo sapiens
gcacctcaaacacctgctga

SEQ ID NO: 12972 - DNA, 21 bp, Homo sapiens
ggtgttgtggtcttccatcca

SEQ ID NO: 12973 - DNA, 20 bp, Homo sapiens
taattggggcggagggttag

SEQ ID NO: 12974 - DNA, 26 bp, Homo sapiens
cagagctagaagaaccaagtcttcct

SEQ ID NO: 12975 - DNA, 20 bp, Homo sapiens
cccacctaatgaagcgcaaa

SEQ ID NO: 12976 - DNA, 19 bp, Homo sapiens
tacgggcaagaagggcatt

SEQ ID NO: 12977 - DNA, 23 bp, Homo sapiens
ctccatgcatttggtattttcgt

SEQ ID NO: 12978 - DNA, 22 bp, Homo sapiens
tgggagttttgctgattccttc

SEQ ID NO: 12979 - DNA, 20 bp, Homo sapiens
cttcagaagcgaggcacagg

SEQ ID NO: 12980 - DNA, 20 bp, Homo sapiens
ctgtcccagagtcccacctg

SEQ ID NO: 12981 - DNA, 20 bp, Homo sapiens
gcccagcctaggatctgaca

SEQ ID NO: 12982 - DNA, 20 bp, Homo sapiens
agaagcaggcccagacagag

SEQ ID NO: 12983 - DNA, 20 bp, Homo sapiens
gccccttgaagacagcagaa

SEQ ID NO: 12984 - DNA, 20 bp, Homo sapiens
ggctgagagtgatgggaacg

SEQ ID NO: 12985 - DNA, 20 bp, Homo sapiens
gatgaacatcggcatgatgg

SEQ ID NO: 12986 - DNA, 30 bp, Homo sapiens
tgtccaagggatatttagaacattttagtt

SEQ ID NO: 12987 - DNA, 26 bp, Homo sapiens
caaatttggtgacagaaaagacttca

SEQ ID NO: 12988 - DNA, 20 bp, Homo sapiens
taaaggaggccccaccaagt

SEQ ID NO: 12989 - DNA, 20 bp, Homo sapiens
gtgtccggctcacaaactcc

SEQ ID NO: 12990 - DNA, 18 bp, Homo sapiens
tggaagcaccaggcatga

SEQ ID NO: 12991 - DNA, 24 bp, Homo sapiens
caagctttgagtgcaagagattga

SEQ ID NO: 12992 - DNA, 20 bp, Homo sapiens
ctgggctttctcccttgcta

SEQ ID NO: 12993 - DNA, 20 bp, Homo sapiens
acatggggaacacaccacag

SEQ ID NO: 12994 - DNA, 23 bp, Homo sapiens
tggctcctgtaggagtctcagaa

SEQ ID NO: 12995 - DNA, 22 bp, Homo sapiens
tggaggcctcactatgttcctc

SEQ ID NO: 12996 - DNA, 20 bp, Homo sapiens
cagaggcattgcatggtgat

SEQ ID NO: 12997 - DNA, 20 bp, Homo sapiens
gaccccttgctggtaggaca

SEQ ID NO: 12998 - DNA, 20 bp, Homo sapiens
gggaggccatacggtttagg

SEQ ID NO: 12999 - DNA, 19 bp, Homo sapiens
ggtcacccgctgctctgta

SEQ ID NO: 13000 - DNA, 20 bp, Homo sapiens
agggggctacatgggaacag

SEQ ID NO: 13001 - DNA, 20 bp, Homo sapiens
aggaagccacaagggaggac

SEQ ID NO: 13002 - DNA, 20 bp, Homo sapiens
gggaatggctcccttgaagt

SEQ ID NO: 13003 - DNA, 21 bp, Homo sapiens
ttgcaggacccataatcctca

SEQ ID NO: 13004 - DNA, 19 bp, Homo sapiens
gcagcaggcctgactttca

SEQ ID NO: 13005 - DNA, 21 bp, Homo sapiens
tcctgctcccaggataggaaa

SEQ ID NO: 13006 - DNA, 20 bp, Homo sapiens
atccgtgagtgggaagtggt

SEQ ID NO: 13007 - DNA, 20 bp, Homo sapiens
ctgctgacccaccaaggtct

SEQ ID NO: 13008 - DNA, 24 bp, Homo sapiens
aattgtggctgaacaaattaacga

SEQ ID NO: 13009 - DNA, 23 bp, Homo sapiens
tgcctaaagtcacggtaggatga

SEQ ID NO: 13010 - DNA, 20 bp, Homo sapiens
gtccaagcccacaaccagag

SEQ ID NO: 13011 - DNA, 19 bp, Homo sapiens
ggagccccagcagcaatag

SEQ ID NO: 13012 - DNA, 20 bp, Homo sapiens
acatctcaccctggcagagc

SEQ ID NO: 13013 - DNA, 23 bp, Homo sapiens
gtcttctgattggaagccacaaa

SEQ ID NO: 13014 - DNA, 29 bp, Homo sapiens
tcaagagtcaggatacactttatttctca

SEQ ID NO: 13015 - DNA, 20 bp, Homo sapiens
gagaggtgagcgggcaataa

SEQ ID NO: 13016 - DNA, 19 bp, Homo sapiens
tcgtgaggcacaagtgcaa

SEQ ID NO: 13017 - DNA, 20 bp, Homo sapiens
aacaggctctgcttgcttgg

SEQ ID NO: 13018 - DNA, 20 bp, Homo sapiens
catgcatgcccacattcact

SEQ ID NO: 13019 - DNA, 19 bp, Homo sapiens
gtggtgctgacggtggtgt

SEQ ID NO: 13020 - DNA, 18 bp, Homo sapiens
ccaaggagccagcagcag

SEQ ID NO: 13021 - DNA, 20 bp, Homo sapiens
aagtgtcccagtggctttgg

SEQ ID NO: 13022 - DNA, 20 bp, Homo sapiens
gcacgcctgaggcatttatt

SEQ ID NO: 13023 - DNA, 19 bp, Homo sapiens
gggtcgaggcttcccattt

SEQ ID NO: 13024 - DNA, 31 bp, Homo sapiens
ttattgtatttgagcctctagaaaagaagtg

SEQ ID NO: 13025 - DNA, 20 bp, Homo sapiens
gggacactcaagcggtttgt

SEQ ID NO: 13026 - DNA, 20 bp, Homo sapiens
tgacagcaactgggacctga

SEQ ID NO: 13027 - DNA, 23 bp, Homo sapiens
cagatactgcgacatagggtgct

SEQ ID NO: 13028 - DNA, 21 bp, Homo sapiens
gaaacagatgaccgtggcatt

SEQ ID NO: 13029 - DNA, 20 bp, Homo sapiens
atctgcaccagctccacctc

SEQ ID NO: 13030 - DNA, 20 bp, Homo sapiens
cattggccagaatccagagg

SEQ ID NO: 13031 - DNA, 20 bp, Homo sapiens
gagacaccccagcccctagt

SEQ ID NO: 13032 - DNA, 20 bp, Homo sapiens
ccagcaccttcctcctctca

SEQ ID NO: 13033 - DNA, 20 bp, Homo sapiens
ggaggcacacacaagttcca

SEQ ID NO: 13034 - DNA, 28 bp, Homo sapiens
tgagtgggacctaccgagagctaggtgg

SEQ ID NO: 13035 - DNA, 20 bp, Homo sapiens
aggagacccgcgcagaggca

SEQ ID NO: 13036 - DNA, 32 bp, Homo sapiens
tcaacatgagaaatgttgaccacacactgtga

SEQ ID NO: 13037 - DNA, 32 bp, Homo sapiens
tgctggcatcttagaagcagttctcaaagagc

SEQ ID NO: 13038 - DNA, 33 bp, Homo sapiens
ggagctgaacaggaagtaagaataggtggtgca

SEQ ID NO: 13039 - DNA, 20 bp, Homo sapiens
cgcctgcctccaggtgctgg

SEQ ID NO: 13040 - DNA, 30 bp, Homo sapiens; identical to SEQ ID NO: 2209

SEQ ID NO: 13041 - DNA, 24 bp, Homo sapiens
gggctggcaacttagaggtgggga

SEQ ID NO: 13042 - DNA, 31 bp, Homo sapiens; identical to SEQ ID NO: 12811

SEQ ID NO: 13043 - DNA, 30 bp, Homo sapiens
ccctcaaggtaagactaagatgggaggggg

SEQ ID NO: 13044 - DNA, 30 bp, Homo sapiens
ccccctcccaaaagaagtatgacacacaca

SEQ ID NO: 13045 - DNA, 25 bp, Homo sapiens
caacccaaaccggttgtttccctca

SEQ ID NO: 13046 - DNA, 29 bp, Homo sapiens
ggaaaaggcaatagacagggaaagccagc

SEQ ID NO: 13047 - DNA, 20 bp, Homo sapiens
tctaccccaggcctcggcgc

SEQ ID NO: 13048 - DNA, 29 bp, Homo sapiens
gcctcatcttcaacttttgtgctcccctt

SEQ ID NO: 13049 - DNA, 33 bp, Homo sapiens
gggaaatacaggaataggggaacatatcccaca

SEQ ID NO: 13050 - DNA, 25 bp, Homo sapiens
tgccttggctcagacatgttttccg

SEQ ID NO: 13051 - DNA, 30 bp, Homo sapiens
gcaactaggtcctgagaaagccctctctcg

SEQ ID NO: 13052 - DNA, 20 bp, Homo sapiens
cccggcccacattggtccct

SEQ ID NO: 13053 - DNA, 28 bp, Homo sapiens
tgctgtgtgtcaatcactcatcagcacc

SEQ ID NO: 13054 - DNA, 25 bp, Homo sapiens
gcagatcagtgccttcctggttgcc

SEQ ID NO: 13055 - DNA, 27 bp, Homo sapiens
tccatttccatggttggccttgttctc

SEQ ID NO: 13056 - DNA, 25 bp, Homo sapiens
gaggtggcagcttaggaagctgggg

SEQ ID NO: 13057 - DNA, 21 bp, Homo sapiens
caccctggccaccacccaacc

SEQ ID NO: 13058 - DNA, 33 bp, Homo sapiens
gcatccacagatccctcaaaacattttaaaagg

SEQ ID NO: 13059 - DNA, 20 bp, Homo sapiens
acatgcagtgccggctccgg

SEQ ID NO: 13060 - DNA, 24 bp, Homo sapiens
cctgcctcttccaggaagaccccc

SEQ ID NO: 13061 - DNA, 26 bp, Homo sapiens
tcccagaatcccctttacccagctca

SEQ ID NO: 13062 - DNA, 29 bp, Homo sapiens
ctcaaacctgaaatcagaagagggccatg

SEQ ID NO: 13063 - DNA, 33 bp, Homo sapiens; identical to SEQ ID NO: 12885

SEQ ID NO: 13064 - DNA, 20 bp, Homo sapiens
gggaagggctgggggaggga

SEQ ID NO: 13065 - DNA, 28 bp, Homo sapiens
tgcttctcagtcccacacaaggaagctg

SEQ ID NO: 13066 - DNA, 29 bp, Homo sapiens
tgggcatctttatcttggtttccacgagc

SEQ ID NO: 13067 - DNA, 33 bp, Homo sapiens
tcagtcctattcattcatcacctttctgggaga

SEQ ID NO: 13068 - DNA, 22 bp, Homo sapiens
ccccacacagggcaggtgacct

SEQ ID NO: 13069 - DNA, 20 bp, Homo sapiens
caccaccgcctctgcctccg

SEQ ID NO: 13070 - DNA, 20 bp, Homo sapiens
tcaggccccagaccccagca

SEQ ID NO: 13071 - DNA, 28 bp, Homo sapiens
agacccaccttgacctggcctacagaag

SEQ ID NO: 13072 - DNA, 22 bp, Homo sapiens
gaaggccttccgtcggcgttgt

SEQ ID NO: 13073 - DNA, 463 bp, Homo sapiens; identical to SEQ ID NO: 3083

SEQ ID NO: 13074 - DNA, 491 bp, Homo sapiens; identical to SEQ ID NO: 3084

SEQ ID NO: 13075 - DNA, 327 bp, Homo sapiens; identical to SEQ ID NO: 3096

SEQ ID NO: 13076 - DNA, 20 bp, Homo sapiens
tgtggccgaggactttgatt

SEQ ID NO: 13077 - DNA, 20 bp, Homo sapiens
gggggcttagtttgcttcct

SEQ ID NO: 13078 - DNA, 20 bp, Homo sapiens
aagtgcagcgttccttttgc

SEQ ID NO: 13079 - DNA, 20 bp, Homo sapiens
agcgttccttttgcgagaga

SEQ ID NO: 13080 - DNA, 20 bp, Homo sapiens
cgggctgttttccaaacatt

SEQ ID NO: 13081 - DNA, 20 bp, Homo sapiens
gaagggacacgcaggtggta

SEQ ID NO: 13082 - DNA, 20 bp, Homo sapiens
aaacaatggcatgcctccac

SEQ ID NO: 13083 - DNA, 20 bp, Homo sapiens
gggggcttagtttgcttcct
